(12) United States Patent
Schryvers et al.

(10) Patent No.: US 10,149,900 B2
(45) Date of Patent: Dec. 11, 2018

(54) IMMUNOGENIC COMPOSITIONS AND VACCINES DERIVED FROM BACTERIAL SURFACE RECEPTOR PROTEINS

(71) Applicants: Anthony B. Schryvers, Calgary (CA); Trevor F. Moraes, Toronto (CA); Scott Gray-Owen, Oakville (CA)

(72) Inventors: Anthony B. Schryvers, Calgary (CA); Trevor F. Moraes, Toronto (CA); Scott Gray-Owen, Oakville (CA)

(73) Assignee: Engineered Antigens Inc., Calgary, Alberta (CA)

( * ) Notice: Subject to any disclaimer, the term of this patent is extended or adjusted under 35 U.S.C. 154(b) by 0 days.

(21) Appl. No.: 15/100,867

(22) PCT Filed: Dec. 1, 2014

(86) PCT No.: PCT/CA2014/051146
§ 371 (c)(1),
(2) Date: Jun. 1, 2016

(87) PCT Pub. No.: WO2015/081430
PCT Pub. Date: Jun. 11, 2015

(65) Prior Publication Data
US 2016/0303217 A1 Oct. 20, 2016

Related U.S. Application Data

(60) Provisional application No. 61/910,817, filed on Dec. 2, 2013, provisional application No. 62/007,068, filed on Jun. 3, 2014.

(51) Int. Cl.
| | |
|---|---|
| *C07K 14/195* | (2006.01) |
| *A61K 39/104* | (2006.01) |
| *A61K 39/095* | (2006.01) |
| *A61K 39/102* | (2006.01) |
| *C07K 14/22* | (2006.01) |
| *C07K 14/285* | (2006.01) |
| *A61K 39/00* | (2006.01) |

(52) U.S. Cl.
CPC ........ *A61K 39/1045* (2013.01); *A61K 39/095* (2013.01); *A61K 39/102* (2013.01); *C07K 14/195* (2013.01); *C07K 14/22* (2013.01); *C07K 14/285* (2013.01); *A61K 2039/523* (2013.01); *A61K 2039/70* (2013.01)

(58) Field of Classification Search
None
See application file for complete search history.

(56) References Cited

U.S. PATENT DOCUMENTS

| | | |
|---|---|---|
| 5,292,869 A | 3/1994 | Schryvers |
| 6,326,350 B1 | 12/2001 | Jacobs et al. |
| 6,348,198 B1 | 2/2002 | Schryvers et al. |
| 6,610,506 B1 | 8/2003 | Lo |
| 7,118,749 B2 | 10/2006 | Loosmore et al. |
| 7,241,449 B1 | 7/2007 | Myers et al. |
| 2004/0258695 A1 | 12/2004 | Schryvers |

OTHER PUBLICATIONS

Martinez-Martinez, Sonia et al., "A vaccine based on a mutant transferrin binding protein B of Haemophilus parasuis induces a strong T-helper 2 response and bacterial clearance after experimental infection", Veterinary Immunology and Immunopathology, Elsevier BV, Amsterdam, NL, vol. 179, p. 18-25, Jul. 26, 2016.
Martinez-Martinez, S. et al., "Molecular analysis of lungs from pigs immunized with a mutant transferrin binding protein B-based vaccine and challenged with Haemophilus parasuis", Comparative Immunology, Microbiology and Infectious Diseases, Pergamon Press, Oxford, GB, vol. 48, p. 69-78, Aug. 12, 2016.
Beernink, P.T. et al., "A Meningococcal Factor H Binding Protein Mutant that Eliminates Factor H Binding Enhances Protective Antibody Responses to Vaccination", The Journal of Immunology, vol. 186, No. 6, p. 3606-3614, Mar. 15, 2011.
Frandoloso, R. et al., "Development and Characterization of Protective Haemophilus parasuis Subunit Vaccines Based on Native Proteins with Affinity to Porcine Transferrin and Comparison With Other Clinical and Vaccine Immunology", vol. 18, No. 1, p. 50-58, Jan. 1, 2011.
Frandoloso, R. et al., "Nonbinding Site-Directed Mutants of Transferrin Binding Protein B Exhibit Enhanced Immunogenicity and Protective Capabilities", Infection and Immunity, vol. 83, No. 3, p. 1030-1038, Dec. 29, 2014.
Noinaj, N., et al., "The transferrin-iron import system from pathogenic *Neisseria* species", Mal. Microbial., vol. 86, No. 2, pp. 246-257, Sep. 7, 2012 (Sep. 7, 2012), ISSN: 1365-2958.
Noinaj, N., et al., "Structural basis for iron piracy by pathogenic Neisseria", Nature, vol. 483, pp. 53-58, I Mar. 2012 (Mar. 1, 2012), ISSN: 0028-0836.
Boulton, I.C., et al., "Identification of discrete domains within gonococcal transferrin-binding protein A that are necessary for ligand binding and iron uptake functions", Infect. Immun., vol. 68, No. 12, pp. 6988-6996, Dec. 2000 (Dec. 2000), ISSN:0019-9567.
Calmettes, C., et al., "The structural basis of transferrin sequestration by transferrin-binding protein B", Nature Structural & Molecular Biology, vol. 19, No. 3, pp. 358-360, Mar. 2012 (Mar. 2012), ISSN: 1545-9993.

(Continued)

*Primary Examiner* — Brian Gangle
(74) *Attorney, Agent, or Firm* — Bereskin & Parr LLP/S.E.N.C.R.L., s.r.l.; Micheline Gravelle

(57) ABSTRACT

The disclosure provides immunogenic compositions comprising a polypeptide comprising a C-lobe domain or an N-lobe domain of a HIBP surface receptor protein obtainable from or obtained from a Gram-negative bacterial species. The HIBP surface receptor proteins have been modified in such a manner that they are unable to bind host iron binding protein. Methods of making and using these immunogenic positions to prepare animal and human vaccines are also provided.

33 Claims, 37 Drawing Sheets
Specification includes a Sequence Listing.

(56) References Cited

OTHER PUBLICATIONS

Sims, K.L., et al., "Peptide-peptide interactions between human transferrin and transferrin-binding protein B from Moraxella catarrholis", J. Bacterial., vol. 185, No. 8, pp. 2603-2610, Apr. 2003 (Apr. 2003), ISSN: 0021-9193.

Pettersson, A., et al., "Vaccine potential of the Neisseria meningitidis lactoferrin-binding proteins LbpA and LbpB", Vaccine, vol. 24, pp. 3545-3557, 2006, ISSN:0254-410X.

Ling, J.M.L , et al , "Delineating the regions of human transferrin involved in interactions with transferrin binding protein B from Neisseria meningitidis", Mol. Microbial., vol. 77, No. 5, pp. 1301-1314, 2010, ISSN: 1365-2958.

Price GA, Masri HP, Hollander AM, Russell MW, Cornelissen CN. 2007. "Gonococcal transferrin binding protein chimeras induce bactericidal and growth inhibitory antibodies in mice", Vaccine 25:7247-7260.

Price GA, Hobbs MM, Cornelissen CN. 2004. "Immunogenicity of gonococcal transferrin binding proteins during natural infections", Infect Immun 72:277-283.

Price GA, Russell MW, Cornelissen CN. 2005. "Intranasal administration of recombinant Neisseria gonorrhoeae transferrin binding proteins A and B conjugated to the cholera toxin B subunit induces systemic and vaginal antibodies in mice", Infect Immun 73:3945-3953.

Yost-Daljev MK, Cornelissen CN. 2004. "Determination of surface-exposed, functional domains of gonococcal transferrin-binding protein A", Infect Immun 72:1775-1785.

Cornelissen CN, Anderson JE, Boulton IC, Sparling PF. 2000. "Antigenic and sequence diversity in gonococcal transferrin binding protein A", Infection and Immunity 68:4725-4735.

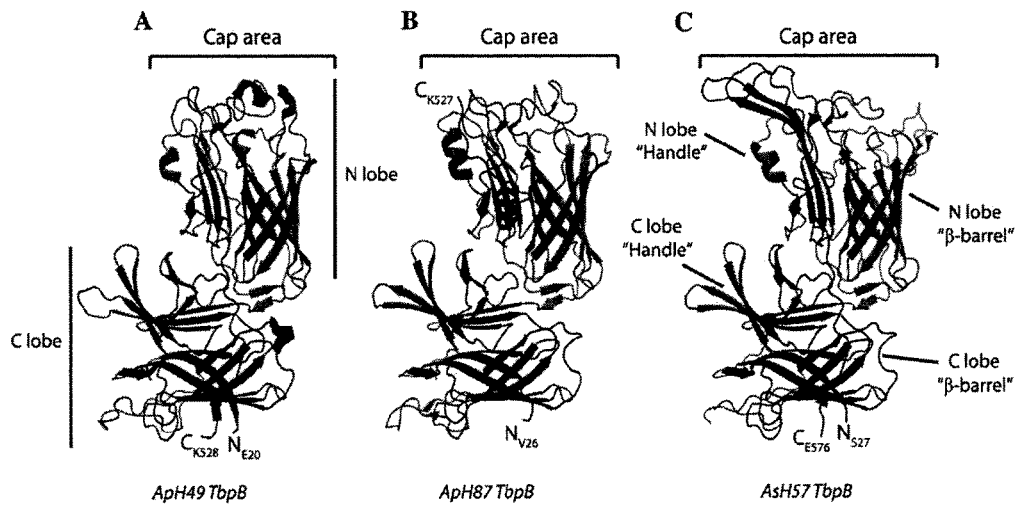
FIGURE 1 - CONTINUED

Panel A
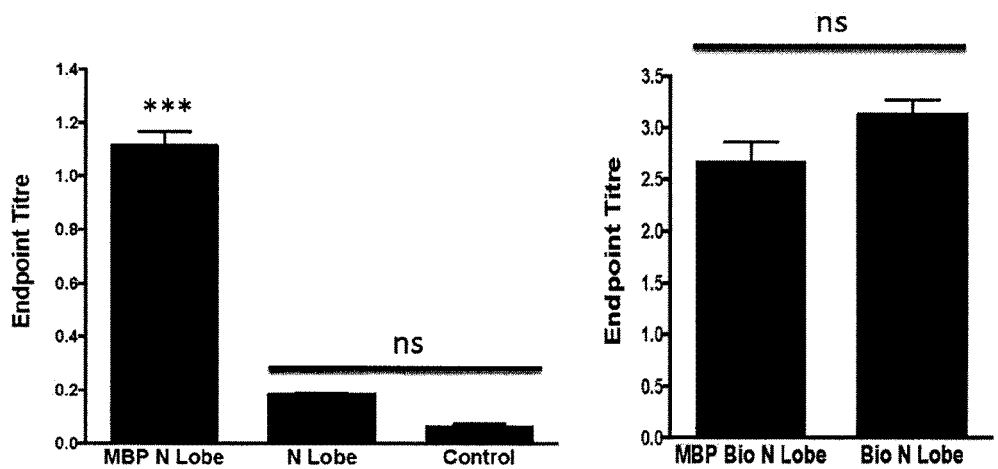
Panel B
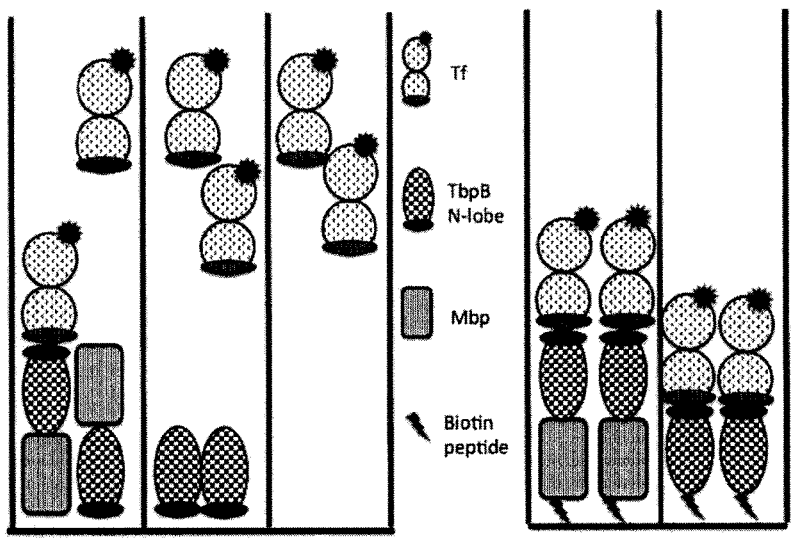
FIGURE 5

Panel A

```
GACACCGTTCGTATTATTGATGCCTCAAAAATTGATTTAACTAATTTCAGCATTTCAGAACTTAACAATTTTGGTGATGCTTCCGTTTTAATTAT
▸ D T V R I   I D A S K   I D L T N F S   I S E L N N F G D A S V L   I I
TGATGGGAAAAAAATAAAGCTAGCTGGTAGCGGGTTTACAAATAAGCACACTATTGAAATCAATGGCAAAACAATGGTAGCCGTAGCCTGCTGTA
▸ D G K K   I K L A G S G F T N K H T   I E   I N G K T M V A V A C C
GTAATCTGGAATATATGAAGTTTGGTCAATTATGGCAACAAGCAGAGGGCGGAAAACCCGAGAATAATAGTTTATTCCTACAAGGCGAACGTACC
▸S N L E Y M K F G Q L W Q Q A E G G K P E N N S L F L Q G E R T
GCAACAGATAAGATGCCAAAAGGCGGAAACTATAAATATATTGGTACTTGGGATGCTCAGGTTTCAAAAGAAAATAACTGGGTTGCTACGGCAGA
▸ A T D K M P K G G N Y K Y   I G T W D A Q V S K E N N W V A T A D
TGATGATAGAAAAGCTGGCTATCGCACAGAATTTGATGTTGATTTTGGCAACAAAAATTTAAGTGGTAAGTTATTTGATAAAAACGGTGTAAATC
▸ D D R K A G Y R T E F D V D F G N K N L S G K L F D K N G V N
CTGTGTTTACCGTAGATGCAAAAATTGATGGTAATGGTTTTACTGGCAAAGCTAAAACCTCAGATGCTGGTTTCGCTCTAGATTCAGGTAGTTCA
▸P V F T V D A K   I D G N G F T G K A K T S D A G F A L D S G S S
CGTTATGAGAATGTGAAATTTAACGATGTAGCAGTTAGTGGTGGCTTCTATGGTCCAACGGCAGCAGAGCTTGGCGGACAATTCCACCATAAATC
▸ R Y E N V K F N D V A V S G G F Y G P T A A E L G G Q F H H K S
AGAAAATGGCAGTGTAGGTGCTGTCTTTGGTGCAAAACAACAAGTAAAAAAACTTGAAACAGTCAAGATCATTGATGCCTCAAAAATTGATTTAA
▸ E N G S V G A V F G A K Q Q V K K
                                    ▸L E T V K   I   I D A S K   I D L
CTACTTTTGAATCATCGGAACTCAACAATTTCGGCAACGCTAATGTGTTAATTATTGATGGACAGAAAATAGATCTAGCAGGTGCAGATTTTAAA

▸T T F E S S E L N N F G N A N V L   I   I D G Q K   I D L A G A D F K
AATAGAAAAACCGTTGATATCAATGGTAAGACAATGGTAGCCATAGCTTGCTGTAGTAATTTGGAATATATGAAATTTGGTCAATTATGGCAAAA

▸N R K T V D   I N G K T M V A   I A C C S N L E Y M K F G Q L W Q K
AGAGGGCGAACAAACTAAAGATAATAGCTTATTCCTGCAAGGTGAGCGTACTGCCACAGATAAAATACCCGTAGGTGGAAACTATAAATATGTAG

▸ E G E Q T K D N S L F L Q G E R T A T D K   I P V G G N Y K Y V
GAACCTGGGATGCACTCGTTTCAAAAGGAACGAACTGGGTAGCTGAGGCGGATAATAATCGAGAATCGGGCTATCGCTCAGAATTTGATGTTAAT

▸G T W D A L V S K G T N W V A E A D N N R E S G Y R S E F D V N
TTTGGTGATAAAAAAGTAAGCGGCAAGTTATTTGATAAAGGGGGCATAGTACCTGTCTTTATGATCAACGCAGATATTAAAGGTAACGGCTTTAC

▸ F G D K K V S G K L F D K G G   I V P V F M   I N A D   I K G N G F T
TGGGACAGCTAACACTACAGATACAGGCTTTGCGTTAGATTCAGGCTCTAGCCAACACGGAAATGCGGTATTTAGTGATATAAAAGTCAATGGTG

▸ G T A N T T D T G F A L D S G S S Q H G N A V F S D   I K V N G
GCTTCTATGGTCCAACCGCTGGAGAACTTGGCGGACAATTCCATCATAAATCAGACAATGGCAGTGTTGGCGCTGTCTTTGGTGCAAAACGACAA

▸G F Y G P T A G E L G G Q F H H K S D N G S V G A V F G A K R Q
ATAGAAAAAACGACCACAGAACGAATCATTGATGCAACTAAAATTGATTTAACCCAATTTAATGCTAAAGAACTCAACAATTTTGGTGATGCCTC
          ▸T T T E R   I   I D A T K   I D L T Q F N A K E L N N F G D A S
▸ I E K
TGTTTTAATTATTGATGGACAAAAAATAGATCTAGCAGGTGTCAATTTTAAAAATAGTAAAACGGTTGAAATCAACGGCAAAACAATGGTAGCCG
▸ V L   I   I D G Q K   I D L A G V N F K N S K T V E   I N G K T M V A
TAGCTTGCTGTAGTAATCTGGAATATATGAAATTTGGTCAATTGTGGCAAAAAGAGGGCAAACAACAAGTTAAAGATAATAGTTTATTCCTACAA
▸V A C C S N L E Y M K F G Q L W Q K E G K Q Q V K D N S L F L Q
GGTGAACGTACTGCAACGGATAAAATGCCCGCAGGAGGTAACTATAAGTATGTTGGAACTTGGGATGCACTCGTATCTAAAGGGACGAACTGGAT
▸G E R T A T D K M P A G G N Y K Y V G T W D A L V S K G T N W   I
AGCGGAAGCAGATAATAATCGAGAATCGGGCTATCGCACTGAATTTGATGTTAATTTTAGTGATAAAAAAGTAAACGGTAAGTTATTTGATAAAG
▸ A E A D N N R E S G Y R T E F D V N F S D K K V N G K L F D K
GCGGTGTAAATCCTGTATTTACCGTAGATGCGACAATTAATGGTAATGGCTTTATCGGCAGTGCGAAAACCTCTGATAGTGGCTTTGCTTTAGAT
▸G G V N P V F T V D A T   I N G N G F   I G S A K T S D S G F A L D
GCAGGCTCTAGCCAACACGGAAATGCGGTATTTAGTGATATAAAAGTCAATGGTGGCTTCTATGGTCCAACCGCTGGAGAACTTGGCGGACAATT
▸ A G S S Q H G N A V F S D   I K V N G G F Y G P T A G E L G G Q F
CCATCATAAATCAGACAATGGCAGTGTTGGCGCTGTCTTTGGTGCAAAACGACAAATAGAAAAA
▸ H H K S D N G S V G A V F G A K R Q   I E K
```

Sequence Diversity of *Neisseria meningitidis* TbpB C-lobes

Panel A

```
GGATCTTCTGAAAACAGTAAGCTGACCACGGTTTTGGATGCGGTTGAATTGACACTAAACGACAAGAAAATCAAAAATCTCGACAACTTCAGCAATGCCGC
▸ G S S E N S K L T T V L D A V E L T L N D K K I K N L D N F S N A A
CCAACTGGTTGTCGACGGCATTATGATTCCGCTCCTGCCCAAGGATTCCGAAAGCGGGAACACTCAGGCAGATAAAGGTAAAAACGGCGGAACAGAATTTA
▸ Q L V V D G I M I P L L P K D S E S G N T Q A D K G K N G G T E F
CCCGCAAATTTGAACACACGCCGGAAAGTGATAAAAAAGACGCCCAAGCAGGTACGCAGACGAATGGGGCGCAAACCGCTTCAAATACGGCAGGTGATACC
▸ T R K F E H T P E S D K K D A Q A G T Q T N G A Q T A S N T A G D T
AATGGCAAAACAAAAACCTATGAAGTCGAAGTCTGCTGTTCCAACCTCAATTATCTGAAATACGGAATGTTGACGCGCAAAAACAGCAAGTCCGCGATGCA
▸ N G K T K T Y E V E V C C S N L N Y L K Y G M L T R K N S K S A M Q
GGCAGGAGGAAACAGTAGTCAAGCTGATGCTAAAACGGAACAAGTTGAACAAAGTATGTTCCTCCAAGGCGAGCGTACCGATGAAAAAGAGATTCCAACCG
▸ A G G N S S Q A D A K T E Q V E Q S M F L Q G E R T D E K E I P T
ACCAAAACGTCGTTTATCGGGGGTCTTGGTACGGGCATATTGCCAACGGCACAAGCTGGAGCGGCAATGCTTCTGATAAAGAGGGCGGCAACAGGGCGGAA
▸ D Q N V V Y R G S W Y G H I A N G T S W S G N A S D K E G G N R A E
TTTACTGTGAATTTTGCCGATAAAAAAATTACCGGCAAGTTAACCGCTGAAAACAGGCAGGCGCAAACCTTTACCATTGAGGGAATGATTCAGGGCAACGG
▸ F T V N F A D K K I T G K L T A E N R Q A Q T F T I E G M I Q G N G
CTTTGAAGGTACGGCGAAAACTGCTGAGTCAGGTTTTGATCTCGATCAAAAAAATACCACCCGCACGCCTAAGGCATATATCACAGATGCCAAGGTAAAGG
▸ F E G T A K T A E S G F D L D Q K N T T R T P K A Y I T D A K V K
GCGGTTTTTACGGGCCTAAAGCCGAAGAGTTGGGCGGATGGTTTGCCTATCCGGGCGATAAACAAACGGAAAAGGCAACAGCTACATCCAGCGATGGAAAT
▸ G G F Y G P K A E E L G G W F A Y P G D K Q T E K A T A T S S D G N
TCAGCAAGCAGCGCGACCGTGGTATTCGGTGCGAAACGCCAACAGCCTGTGCAAGGGGAAAACGCGGCAGGGCCTGCAACGGAAACCGTGATAGATGC
▸ S A S S A T V V F G A K R Q Q P V Q G E N A A G P A T E T V I D A
ATACCGTATTACCGGCGAGGAGTTTAAGAAAGAGCAAATAGACAGTTTTGGAGATGTGAAAAAGCTGCTGGTTGACGGAGTGGAGCTTTCACTGCTGCCGT
▸ Y R I T G E E F K K E Q I D S F G D V K K L L V D G V E L S L L P
CTGAGGGCAATAAGGCGGCATTTCAGCACGAGATTGAGCAAAACGGCGTGAAGGCAACGGTGTGTTGTTCCAACTTGGATTACATGAGTTTTGGGAAGCTG
▸ S E G N K A A F Q H E I E Q N G V K A T V C C S N L D Y M S F G K L
TCAAAAGAAAATAAAGACGATATGTTCCTGCAAGGTGTCCGCACTCCAGTATCCGATGTGGCGGCAAGGACGGAGGCAAACGCCAAATATCGCGGTACTTG
▸ S K E N K D D M F L Q G V R T P V S D V A A R T E A N A K Y R G T W
GTACGGATATATTGCCAACGGCACAAGCTGGAGCGGCGAAGCCTCCAATCAGGAAGGTGGTAATAGGGCAGAGTTTGACGTGGATTTTTCCACTAAAAAAA
▸ Y G Y I A N G T S W S G E A S N Q E G G N R A E F D V D F S T K K
TCAGTGGCACACTGACGGCAAAAGACCGTACGTCTCCTGCGTTTACTATTACTGCCATGATTAAGGACAACGGTTTTTCAGGTGTGGCGAAAACCGGTGAA
▸ I S G T L T A K D R T S P A F T I T A M I K D N G F S G V A K T G E
AACGGCTTTGCGCTGGATCCGCAAAATACCGGAAATTCCCACTATACGCATATTGAAGCCACTGTATCCGGCGGTTTCTACGGCAAAAACGCCATCGAGAT
▸ N G F A L D P Q N T G N S H Y T H I E A T V S G G F Y G K N A I E M
GGGCGGATCGTTCTCATTTCCGGGAAATGCACCAGAGGGAAAACAAGAAAAAGCATCGGTGGTATTCGGTGCGAAACGCCAACAGCTTGTGCAA
▸ G G S F S F P G N A P E G K Q E K A S V V F G A K R Q Q L V Q
```

Panel B

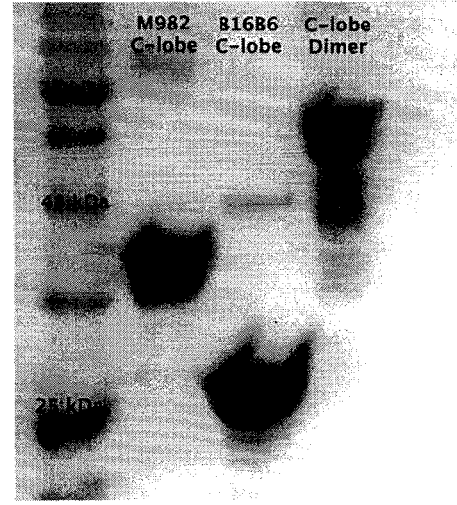

FIGURE 12

Panel A

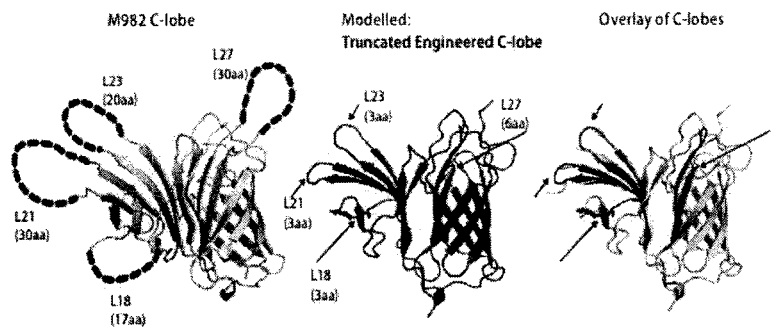

Panel B

```
                    10         20         30         40         50         60         70
wt            1  SSSENSKLTT VLDAVELTLN DKKIKNLDNF SNAAQLVVDG IMIPLLPKDS ESGNTQADKG KNGGTEFTRK
loop1         1  SSSENSKLTT VLDAVELTLN DKKIKNLDNF SNAAQLVVDG IMIDL--loop 18--- --AGTEFTRK
loop2         1  SSSENSKLTT VLDAVELTLN DKKIKNLDNF SNAAQLVVDG IMIPLLPKDS ESGNTQADKG KNGGTEFTRK
loop3         1  SSSENSKLTT VLDAVELTLN DKKIKNLDNF SNAAQLVVDG IMIPLLPKDS ESGNTQADKG KNGGTEFTRK
loop4         1  SSSENSKLTT VLDAVELTLN DKKIKNLDNF SNAAQLVVDG IMIPLLPKDS ESGNTQADKG KNGGTEFTRK
loopless      1  SSSENSKLTT VLDAVELTLN DKKIKNLDNF SNAAQLVVDG IMIDL--loop 18--- --AGTEFTRK
wt           71  FEHTPESDKK DAQAGTQTNG AQTASNTAGD TNGKTKTYEV EVCCSNLNYL KYGMLTRKNS KSAMQAGGNS
loop1        54  FEHTPESDKK DAQAGTQTNG AQTASNTAGD TNGKTKTYEV EVCCSNLNYL KYGMLTRKNS KSAMQAGGNS
loop2        71  FEHT---- --loop 21----- ----INGKT--YEV EVCCSNLNYL KYGMLTRKNS KSAMQAGGNS
loop3        71  FEHTPESDKK DAQAGTQTNG AQTASNTAGD TNGKTKTYEV EVCCSNLNYL KYGMLTRKG- loop 23-
loop4        71  FEHTPESDKK DAQAGTQTNG AQTASNTAGD TNGKTKTYEV EVCCSNLNYL KYGMLTRKNS KSAMQAGGNS
loopless     54  FEHT---- --loop 21----- ----INGKT--YEV EVCCSNLNYL KYGMLTRKG- loop 23-
wt          141  SQADAKTEQV EQSMFLQGER TDEKEIPTDQ NVVYRGSWYG HIANGTSWSG NASDKEGGNR AEFTVNFADK
loop1       124  SQADAKTEQV EQSMFLQGER TDEKEIPTDQ NVVYRGSWYG HIANGTSWSG NASDKEGGNR AEFTVNFADK
loop2       113  SQADAKTEQV EQSMFLQGER TDEKEIPTDQ NVVYRGSWYG HIANGTSWSG NASDKEGGNR AEFTVNFADK
loop3       130  -----KQV EQSMFLQGER TDEKEIPTDQ NVVYRGSWYG HIANGTSWSG NASDKEGGNR AEFTVNFADK
loop4       141  SQADAKTEQV EQSMFLQGER TDEKEIPTDQ NVVYRGSWYG HIANGTSWSG NASDKEGGNR AEFTVNFADK
loopless     85  -----KQV EQSMFLQGER TDEKEIPTDQ NVVYRGSWYG HIANGTSWSG NASDKEGGNR AEFTVNFADK
wt          211  KITGKLTAEN RQAQTFTIEG MIQGNGFEGT AKTAESGFDL DQKNTTRTPK AYITDAKVKG GFYGPKAEEL
loop1       194  KITGKLTAEN RQAQTFTIEG MIQGNGFEGT AKTAESGFDL DQKNTTRTPK AYITDAKVKG GFYGPKAEEL
loop2       183  KITGKLTAEN RQAQTFTIEG MIQGNGFEGT AKTAESGFDL DQKNTTRTPK AYITDAKVKG GFYGPKAEEL
loop3       193  KITGKLTAEN RQAQTFTIEG MIQGNGFEGT AKTAESGFDL DQKNTTRTPK AYITDAKVKG GFYGPKAEEL
loop4       211  KITGKLTAEN RQAQTFTIEG MIQGNGFEGT AKTAESGFDL DQKNTTRTPK AYITDAKVKG GFYGPKAEEL
loopless    148  KITGKLTAEN RQAQTFTIEG MIQGNGFEGT AKTAESGFDL DQKNTTRTPK AYITDAKVKG GFYGPKAEEL
wt          281  GGWFAYPGDK QTEKATATSS DGNSASSATV VFGAKRQQPV Q
loop1       264  GGWFAYPGDK QTEKATATSS DGNSASSATV VFGAKRQQPV Q
loop2       253  GGWFAYPGDK QTEKATATSS DGNSASSATV VFGAKRQQPV Q
loop3       263  GGWFAYPGDK QTEKATATSS DGNSASSATV VFGAKRQQPV Q
loop4       281  GGWFAY--loop 27-HKSD NG----SATV VFGAKRQQPV Q
loopless    218  GGWFAY--loop 27-HKSD NG----SATV VFGAKRQQPV Q
```

FIGURE 14

Panel A

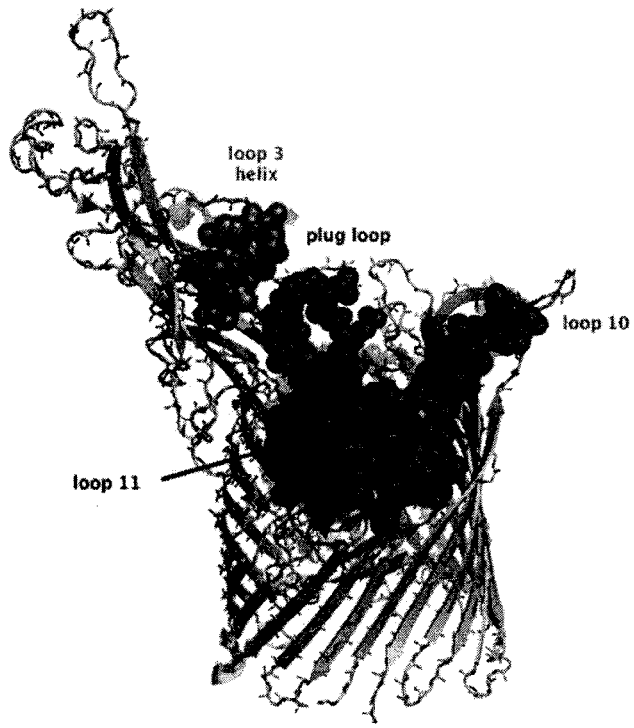

Panel B

```
% matched: 76           10         20         30         40         50         60         70
                 ..........|.........|.........|.........|.........|.........|.........|
TbpA loops     1 SSSENSKLTT VLDAVELTLN DKKIKNLDNF SNAAQLVVDG IMIPLLP--- -A KAVFDEN RK GPEFTRK
C-lobe         1 SSSENSKLTT VLDAVELTLN DKKIKNLDNF SNAAQLVVDG IMIPLLPKDS ESGNTQADKG KNGGTEFTRK
loopless C-L   1 SSSENSKLTT VLDAVELTLN DKKIKNLDNF SNAAQLVVDG IMIDL--loop-18-    --AGTEFTRK
TbpA loops    67 FEH AKEITE LLGSRALLNG --NSRNTKA- TARRTR YEV EVCCSNLNYL KYGMLTRK T  WENVRQTAGG
C-lobe        71 FEHTPESDKK DAQAGTQTNG AQTASNTAGD TNGKTKTYEV EVCCSNLNYL KYGMLTRKNS -KSAMQ-AGG
loopless C-L  54 FEHT----  loop 21             INGKT--YEV EVCCSNLNYL KYGMLTRKG- -----------
TbpA loops   134 AVNQHKNVGV YNRYA VEQSM FLQGERTDEK EIPTDQNVVY RGSWYGHIAN GTSWSGNASD KEGGNRAEFT
C-lobe       139 NSSQADA--- -KTEQVEQSM FLQGERTDEK EIPTDQNVVY RGSWYGHIAN GTSWSGNASD KEGGNRAEFT
loopless C-L  85 -loop 23-  --KQVEQSM FLQGERTDEK EIPTDQNVVY RGSWYGHIAN GTSWSGNASD KEGGNRAEFT
TbpA loops   204 VNFADKKITG KLTAENRQAQ TFTIEGMIQG NGFEGTAKTA ESGFDLDQKN TTRTPKAYIT DAKVKGGFYG
C-lobe       205 VNFADKKITG KLTAENRQAQ TFTIEGMIQG NGFEGTAKTA ESGFDLDQKN TTRTPKAYIT DAKVKGGFYG
loopless C-L 142 VNFADKKITG KLTAENRQAQ TFTIEGMIQG NGFEGTAKTA ESGFDLDQKN TTRTPKAYIT DAKVKGGFYG
TbpA loops   274 PKAEELGGWF AY---  TAQ A-ALGGTRTA GS ATVVFGA KRQQPVQ•
C-lobe       275 PKAEELGGWF AYPGDKQTEK ATATSSDGNS ASSATVVFGA KRQQPVQ
loopless C-L 212 PKAEELGGWF AY-loop27 --HKSDNG-- --SATVVFGA KRQQPVQ
```

— TbpA plug loop    TbpA loop 10
— TbpA loop 11      TbpA loop 3 helix

FIGURE 17

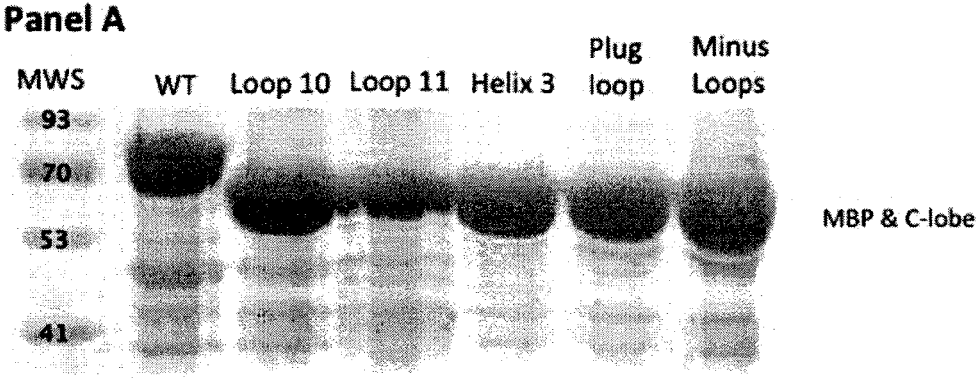
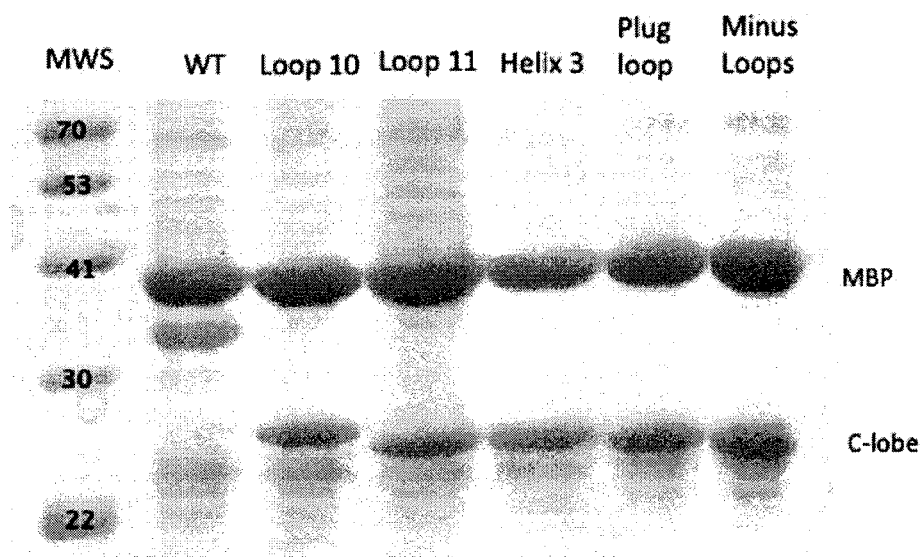
FIGURE 18

Antisera Against 'Loopless' C-lobe with TbpA loop

ELISA Antigen for all samples is the C-lobe with all four TbpA loops

FIGURE 19

Panel A

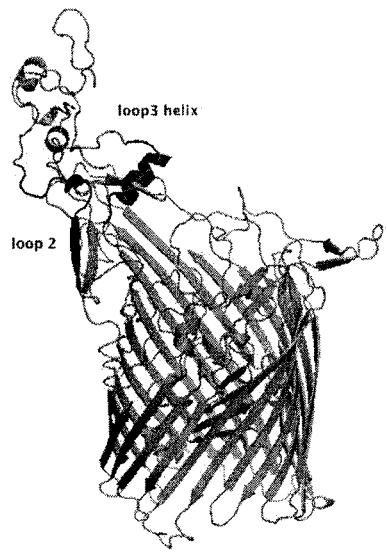

Panel B

```
% matched: 79           10          20          30          40          50          60          70
C-lobe            1  SSSENSKLTT VLDAVELTLN DKKIKNLDNF SNAAQLVVDG IMIPLLPKDS ESGNTQADKG KN-GGTEFTR
loopless C-L..    1  SSSENSKLTT VLDAVELTLN DKKIKNLDNF SNAAQLVVDG IMI--loop 18----------DLAGTEFTR
LbpAhelix3        1  SSSENSKLTT VLDAVELTLN DKKIKNLDNF SNAAQLVVDG IMIPLLY---GTDEAEKF RDKSGVFFTR
LbpAloop2         1  SSSENSKLTT VLDAVELTLN DKKIKNLDNF SNAAQLVVDG IMI-----------------DLAGTEFTR
C-lobe           70  KFEHTPESDK KDAQAGTQTN GAQTASNTAG DTNGKTKTYE VEVCCSNLNY LKYGMLTRKN SKSAMQAGGN
loopless C-L..   53  KFEHTING-- -----loop 21--------- ------KTYE VEVCCSNLNY LKYGMLTRKG -loop 23-
LbpAhelix3       67  KFEHTING-- ---------- ------KTYE VEVCCSNLNY LKYGMLTRKG ----------
LbpAloop2        53  KFEHTLNRWV KE----- --RIEQN--- ----QPLYE VEVCCSNLNY LKYGMLTRKG ----------
C-lobe          140  SSQADAKTEQ VEQSMFLQGE RTDEKEIPTD QNVVYRGSWY GHIANGTSWS GNASDKEGGN RAEFTVNFAD
loopless C-L..   85  ---------KQ VEQSMFLQGE RTDEKEIPTD QNVVYRGSWY GHIANGTSWS GNASDKEGGN RAEFTVNFAD
LbpAhelix3       99  ---------KQ VEQSMFLQGE RTDEKEIPTD QNVVYRGSWY GHIANGTSWS GNASDKEGGN RAEFTVNFAD
LbpAloop2        96  ---------KQ VEQSMFLQGE RTDEKEIPTD QNVVYRGSWY GHIANGTSWS GNASDKEGGN RAEFTVNFAD
C-lobe          210  KKITGKLTAE NRQAQTFTIE GMIQGNGFEG TAKTAESGFD LDQKNTTRTP KAYITDAKVK GGFYGPKAEE
loopless C-L..  147  KKITGKLTAE NRQAQTFTIE GMIQGNGFEG TAKTAESGFD LDQKNTTRTP KAYITDAKVK GGFYGPKAEE
LbpAhelix3      161  KKITGKLTAE NRQAQTFTIE GMIQGNGFEG TAKTAESGFD LDQKNTTRTP KAYITDAKVK GGFYGPKAEE
LbpAloop2       158  KKITGKLTAE NRQAQTFTIE GMIQGNGFEG TAKTAESGFD LDQKNTTRTP KAYITDAKVK GGFYGPKAEE
C-lobe          280  LGGWFAYPGD KQTEKATATS SDGNSASSAT VVFGAKRQQP VQ
loopless C-L..  217  LGGWFAY---loop 27--HKS DNG----SAT VVFGAKRQQP VQ
LbpAhelix3      231  LGGWFAY--- ------HKS DNG----SAT VVFGAKRQQP VQ.
LbpAloop2       228  LGGWFAY--- ------HKS DNG----SAT VVFGAKRQQP VQ.
```

 LbpA loop 2

 LbpA loop 3 helix

BamHI
GGATCCGCGACCACCAGCACCACCGCGAACGCGAAAACCGATGCGACCACCAACGCGGAAAACTTTACCACCAAAGATATTAGCAGCTTTGGCGAAGCGGATTATCTGCTGATTGA
▸ A T T S T T A N A K T D A T T N A E N F T T K D I S S F G E A D Y L L I D
TAACTATCCGGTGCCGCTGCTGCCGGAAACCGAAAACAGCGGCGATTTTGCGACCAGCAAACATTATGAAGTGCGCGATAAAACCTATAAAGTGGAAGCGTGCTGCAAAAACCTGA
▸ N Y P V P L L P E T E N S G D F A T S K H Y E V R D K T Y K V E A C C K N L
GCTATGTGAAATTTGGCATGTATTATGAAACCAAACGCCCGGCGGCGAAACCGAAAGCGCAGAAAAAAAAACGCAAAAAAAAAAAAACCGGCGTGAAAAGCGTGA
▸ S Y V K F G M Y Y E T K R P A A K P K A Q K K K R K K K K T G V K S V
AAAAAGGCAAAAAAAAAATTAAAAAAAAAAAAGGCACCAAAAAAGCGGCGGTGAAAAAAAAAGGCAGCAAAAAAAAAGCGGTGAAAGGCAAAAAAAAAGCGA
▸ K K G K K K I K K K K G T K K A A V K K K G S K K K A V K G K K K A
AAAAACCGAAAAAAAAAAGCCCGACCAAAAAAGGCGGCAGCGGCAGCAAAGGCATTCTGCCGGCGCCGAAAGCGCCGAAAGGCCGCAACATTAAATATCATCA
▸ K K P K K K S P T K K G G S G S K G I L P A P K A P K G R N I K Y H C
GTTTCTGCTGGGCCTGCGCACCGCGAGCAGCAAAATTCCGACCACCGGCAACGTGAAATATCGCGGCAGCTGGTTTGGCTATATTAGCGATGGCGAAACCAGCTATAGCACCACCG
▸ F L L G L R T A S S K I P T T G N V K Y R G S W F G Y I S D G E T S Y S T T
GCGATAAACGCCAGGATAAAAACGCGGTGGCGGAATTTGATGTGAACTTTGCGGAAAAAACCCTGAAAGGCAGCCTGAAACGCGCGGATAGCCAGAACCCGGTGTTTAGCATTGAA
▸ G D K R Q D K N A V A E F D V N F A E K T L K G S L K R A D S Q N P V F S I E
GCGAACTTTAAAAACGGCGGCAACGCGTTTACCGGCACCGCGACCGCGAAAGATCTGGTGATTGATGGCAAAAACAGCCAGACCAAAAACACCCCGATTAACATTACCACCAAAGT
▸ A N F K N G G N A F T G T A T A K D L V I D G K N S Q T K N T P I N I T T K V
GAACGGCGCGTTTTATGGCCCGAACGCGAGCGAACTGGGCGGCTATTTTACCTATAACGGCAAAAACCCGACCGATAAAAACAGCCCGACCGCGAGCAGCCCGAGCAACAGCGAAA
▸ N G A F Y G P N A S E L G G Y F T Y N G K N P T D K N S P T A S S P S N S E
                                                            XbaI  HindIII
AAGCGCGCGCGGCGGTGGTGTTTGGCGCGAAAAAACAGGTGGAAACCAACAACAAATAATCTAGAAGCTT
▸ K A R A A V V F G A K K Q V E T N N K

B

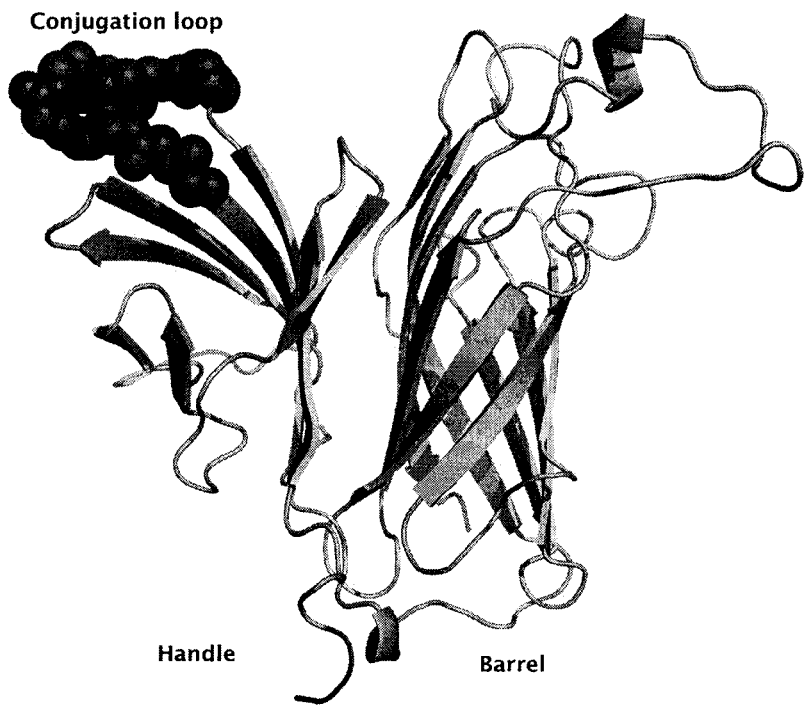

Conjugation loop

Handle     Barrel

FIGURE 21

Affinity binding constants for wild-type and mutant TbpBs

| Protein | Mutation | Loop | Kd | Method |
|---|---|---|---|---|
| ApH49 TbpB | WT | | 55 nM | ITC |
| ApH49 TbpB | F171A | L8 | NDB | ITC |
| ApH49 TbpB | WT | | 44 nM | SPR |
| ApH49 TbpB | F171A | L8 | TBD | SPR |
| ApH87 TbpB | WT | | 60 nM | SPR |
| ApH87 TbpB | Y95A | L3 | 585 nM | SPR |
| ApH87 TbpB | Y121A | L5 | 203 nM | SPR |
| ApH87 TbpB | Y174A | L8 | 8.9 uM | SPR |
| ApH87 TbpB | R179E | L8 | 6.1 uM | SPR |
| AsH57 TbpB | WT | | 120 nM | SPR |
| AsH57 TbpB | F63A | L1 | 326 nM | SPR |
| AsH57 TbpB | F152A | L5 | 495 nM | SPR |
| Hp5 TbpB | WT | | 21 nM | BLI |
| Hp5 TbpB | Y93 A | L3 | TBD | BLI |
| Hp5 TbpB | Y117A | L5 | TBD | BLI |
| Hp5 TbpB (e4535) | Y167A | L8 | 40uM | BLI |
| Hp5 TbpB | W176A | L8 | TBD | BLI |
| Hp5 TbpB (e4597) | Y167A, W176A | L8 | NDB | BLI |

TBD – To Be Determined
NDB – No Detectable Binding
ITC – isothermal titration calorimetry
SPR – surface plasmon resonances
BLI – biolayer interferometry

FIGURE 22

TbpB and TbpB C-lobe Induce Sterilizing Mucosal Immunity
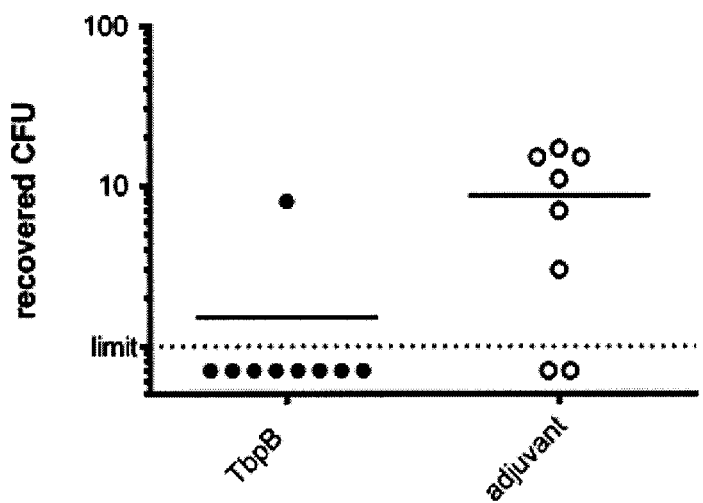
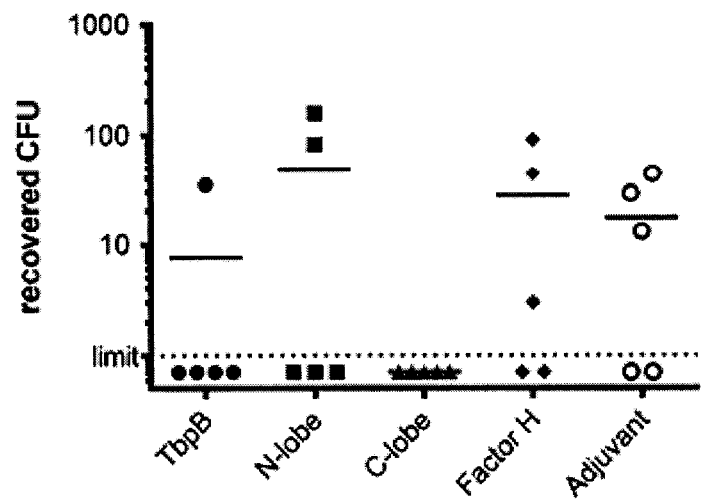
FIGURE 25

FIGURE 29

Sequence Diversity of TbpBs from *Moraxella catarrhalis*

IMMUNOGENIC COMPOSITIONS AND VACCINES DERIVED FROM BACTERIAL SURFACE RECEPTOR PROTEINS

RELATED APPLICATION

This is a national phase entry of PCT/CA2014/051146 filed on Dec. 1, 2014 which claims the benefit under 35 USC § 119(e) from U.S. Provisional Patent Application No. 61/910,817, filed on Dec. 2, 2013 and U.S. Provisional Patent Application No. 62/007,068, filed on Jun. 3, 2014, all of which are incorporated by reference herein in their entirety.

INCORPORATION OF SEQUENCE LISTING

A computer readable form of the Sequence Listing "21806-P45290US02_SequenceListing.txt" (798,720 bytes), submitted via EFS-WEB and created on May 31, 2016, is herein incorporated by reference.

FIELD OF THE DISCLOSURE

The present disclosure relates to immunogenic compositions and vaccines and methods of making and evaluating thereof. More in particular, the disclosure relates to immunogenic compositions derived from bacterial surface receptor proteins and to vaccines against Gram-negative bacterial organisms, including, but not limited to, bacterial organisms belonging to the bacterial families of Pasteurellaceae, Neisseriaceae and Moraxellaceae.

BACKGROUND OF THE DISCLOSURE

The following paragraphs are intended to introduce the reader to the more detailed description that follows and not to define or limit the claimed subject matter of the present disclosure.

Vaccines capable of mediating an effective immune response are important in health strategies aimed at combating diseases caused by microbial pathogens. The two basic strategies for inducing an effect immune response in the host involve either the administration to a subject (host) of a 'live' agent capable of replicating within the host, or the administration of materials or substances that are not capable of replicating in the host. Administration of a live vaccine may represent a safety risk for immune-compromised individuals if the agent or a contaminating organism replicate and adversely affect the immunized subject. These risks are not associated with vaccines based on killed whole pathogens, based on extracts from pathogens or based on purified components, commonly referred to as subunit vaccines. Subunit vaccines avoid the safety problems associated with live vaccines but the purified components may not by themselves deliver the desired protective effect in the subject against the infective microbial organism and require appropriate components, termed adjuvants, to enhance the immune response.

Approaches to the design of vaccines against Gram-negative bacterial organisms have commonly focused on the use of proteins that are naturally associated with the outer membrane of the bacteria and exposed on the surface of the bacterial cells. Particularly attractive targets for vaccination are proteins presumed to be critical for survival in the host as they cannot be lost or dramatically altered in order to avoid the host immune response. In this respect the bacterial surface receptor proteins capable of interacting with and binding to the host iron binding proteins, transferrin and lactoferrin, have for some time been considered suitable components for use in the preparation of vaccines (1-3). This group of surface receptor proteins, hereinafter referred to as "HIBP" (host iron binding protein) surface receptor proteins, is present in pathogens of humans and animals belonging to the bacterial families Pasteurellaceae, Moraxellaceae and Neisseriaceae (4). Thus these proteins have been recognized as potential targets for development of vaccines against a variety of different pathogens of humans and food production animals (5) (6-10).

The HIBP surface receptors normally are comprised of two proteins, a surface lipoprotein, transferrin binding B (TbpB) or lactoferrin binding protein B (LbpB), and a TonB-dependent, integral membrane protein, transferrin binding protein A (TbpA) or lactoferrin binding protein A (LbpA) (11). Recently the detailed three-dimensional structures of TbpBs from *Actinobacillus pleuropneumoniae, Actinobacillus suis*, and *Neisseria meningitidis* were determined at high resolution (12-14). The intrinsic properties of the TbpB or LbpB proteins are quite different from the integral outer membrane proteins, TbpA and LbpA, and substantially impact on the strategies used for vaccine development. For instance, it is possible to produce and purify TbpB or LbpB at relatively high yields from the *E. coli* cytoplasm for the generation of subunit vaccines. However, these proteins are notably absent or deficient in outer membrane vesicle (OMV) vaccines prepared by selective detergent extraction due to their removal during the extraction process. In contrast, functional TbpA or LbpA can only be produced in the outer membrane, providing limitations for producing high yields of purified proteins to be used in subunit vaccines. The alternate approach of producing misfolded proteins that aggregate into large inclusion bodies and subsequently attempt to refold the protein from the enriched inclusion body preparations, are also problematic for commercial production. Thus most strategies for TbpA or LbpA based vaccines would normally involve production of OMVs or development of attenuated strains.

An alternate approach that has been used successfully for invasive bacterial pathogens is to use the extracellular capsular polysaccharide as the primary antigen, and couple it to a protein carrier to induce T-cell help. These conjugate capsular vaccines have proven to be very effective at providing protection from infection by strains expressing the specific capsular polysaccharide but provide no cross-protection to other capsular types. Although conjugate capsular vaccines against the human pathogens *H. influenzae, N. meningitidis* and *Streptococcus pneumoniae* were originally developed to prevent invasive infection, post licensure carriage studies have demonstrated that the systemically administered vaccines eliminated colonization by the pathogens expressing the specific targeted polysaccharides (15-17). This had the added benefit of providing herd immunity, providing protection to non-immunized individuals due to reduced carriage frequency within the population. While not the initial intent of these early vaccines, the potential to confer herd immunity has become an important criterium for evaluating new and upcoming bacterial vaccines. However, determining or predicting whether new vaccines will be capable of impacting or preventing colonization (carriage) is a major challenge (18).

The ability to evaluate whether protein antigens will ultimately be capable of providing broad protection against a diverse set of disease isolates is also a considerable challenge (19). Initial efforts at testing this ability commonly involve immunizing other animal species (mice, rabbits) and then analyzing the cross-reactive and cross-protective properties of the resulting sera. For those surface antigens that can readily be produced in a soluble form, such as surface lipoproteins, a first step is often to produce and purify a set of variant proteins and use them in a standard ELISA (enzyme linked immunosorbent assay) to evaluate the ability of the antisera to recognize the variant proteins. This is fairly labor intensive making analysis of an extensive set of variants an expensive enterprise and relies on the assumption that the binding of the antigen to the ELISA plate is random so that all protein surfaces can be probed.

Considering the limitations in the various assays used to evaluate and predict the cross-protective and cross-reactive properties of antisera raised against antigens, the selection and design of new and improved protein-based vaccines should be pursued in conjunction with development of improved assays so that optimizing and improving vaccines in development can be approached on a rational basis.

Despite considerable efforts over the years since their initial discovery (20, 21), it remains unclear whether and how HIBP surface receptor proteins can be used to prepare efficacious vaccines against Gram-negative bacterial pathogens, and in particular whether and how a broadly protective vaccine can be developed. Thus there is a need in the art to improve immunogenic compositions and vaccines based on HIBP surface receptor proteins against Gram-negative bacterial organisms.

SUMMARY OF THE DISCLOSURE

The present disclosure provides novel immunogenic compositions and in particular immunogenic compositions based on HIBP surface receptor proteins from Gram-negative pathogenic bacterial species.

Accordingly, the present disclosure provides, in at least one embodiment, an immunogenic composition comprising an antigen derived from a HIBP surface receptor protein from a Gram-negative pathogenic bacterial species, wherein the protein derived from the HIBP surface receptor protein has been modified in such a manner that it is unable to substantially bind host iron binding protein.

The present disclosure provides, in at least one embodiment, an immunogenic composition comprising a polypeptide comprising a C-lobe domain or an N-lobe domain of a HIBP surface receptor protein obtainable from or obtained from a Gram-negative bacterial species, wherein the polypeptide is unable to substantially bind host iron binding protein. In preferred embodiments, the present disclosure provides an immunogenic composition comprising a C-lobe domain of a HIBP surface receptor polypeptide, wherein the polypeptide is unable to substantially bind the host iron binding protein. In further preferred embodiments, the present disclosure provides an immunogenic composition comprising a mixture of at least two polypeptides, each polypeptide comprising a C-lobe domain, wherein the C-lobe domains are obtainable or obtained from at least two Gram-negative bacterial species, or from at least two Gram-negative bacterial strains. In further preferred embodiments, the C-lobe domains are obtained from the HIBP surface receptor proteins that are antigenically divergent.

In further embodiments, the present disclosure further provides an immunogenic composition comprising a polypeptide comprising an N-lobe domain and/or a C-lobe domain of an HIBP surface receptor protein obtainable from or obtained from a Gram-negative pathogenic bacterial species, wherein the N-lobe domain or the C-lobe domain comprise a plurality of β-strands connected by a plurality of loop domains, and wherein at least one loop domain of the plurality of loop domains of the N-lobe domain or the C-lobe domain has been modified, and wherein the polypeptide is unable to substantially bind host iron binding protein. In preferred embodiments, the modification comprises the modification of at least one amino acid residue within a loop domain.

In further embodiments, at least two loop domains of the plurality of loop domains within the C-lobe domain and/or the N-lobe domain of an HIBP surface receptor protein have been modified.

In further embodiments, the present disclosure provides (i) a first polypeptide, comprising an N-lobe domain or a C-lobe domain of an HIBP surface receptor protein obtainable from or obtained from a Gram-negative pathogenic bacterial species, wherein the N-lobe domain or the C-lobe domain comprise a plurality of β-strands connected by a plurality of loop domains, and wherein at least one loop domain of the plurality of loop domains of the N-lobe domain or the C-lobe domain has been modified, linked to (ii) a second polypeptide comprising an HIBP surface receptor protein, or a portion thereof, obtainable from a Gram-negative bacterial species, and wherein the linked polypeptide is unable to substantially bind host iron binding protein. In preferred embodiments, the portion of the HIBP surface protein is an N-lobe domain or a C-lobe domain. In further preferred embodiments, the portion of the HIBP surface protein is an N-lobe domain or a C-lobe domain of an HIBP surface receptor protein obtainable from or obtained from a Gram-negative pathogenic bacterial species, wherein the N-lobe domain or the C-lobe domain comprise a plurality of β-strands connected by a plurality of loop domains, and wherein at least one loop domain of the plurality of loop domains of the N-lobe domain or the C-lobe domain has been modified.

In further embodiments, the C-lobe domain or the N-lobe domain is a C-lobe domain or an N-lobe domain of an HIBP surface receptor protein obtainable from or obtained from a bacterial species belonging to the bacterial family of Pasteurellaceae, Moraxellaceae or Neisseriaceae, and in further preferred embodiments, the C-lobe domain or the N-lobe domain is a C-lobe domain or an N-lobe domain of an HIBP surface receptor polypeptide obtainable from or obtained from a bacterial species belonging to the bacterial genus of *Actinobacillus, Neisseria, Haemophilus, Mannheimia, Histophilus, Pasteurella* or *Moraxella*.

In further preferred embodiments, the HIBP surface receptor protein is modified in such a manner that the N-terminal anchor polypeptide of the HIB surface receptor protein, or a portion thereof, is removed, and wherein the polypeptide is unable to substantially bind host iron binding protein.

In other aspects, the present disclosure provides methods for preparing an immunogenic composition. Accordingly, the present disclosure provides a method for preparing an immunogenic composition comprising:
  (a) providing a chimeric nucleic acid sequence comprising as operably linked components:
    (i) a nucleic acid sequence encoding a polypeptide comprising a C-lobe domain or an N-lobe domain of an HIBP surface receptor protein obtainable from or obtained from a Gram-negative bacterial species, wherein the polypeptide is unable to substantially bind host iron binding protein; and
    (ii) a nucleic acid sequence capable of controlling expression in a recombinant host cell;

(b) introducing the chimeric nucleic acid sequence into a host cell and growing the host cell to produce the polypeptide comprising the C-lobe domain or the N-lobe domain;
(c) recovering the polypeptide comprising C-lobe domain or the N-lobe domain from the host cell; and
(d) preparing an immunogenic composition.

In further embodiments, the C-lobe domain or the N-lobe domain comprises a plurality of β-strands connected by a plurality of loop domains, wherein at least one loop domain of the plurality of loop domains has been modified.

In yet further aspects, methods for eliciting an immune response in a vertebrate subject are provided. Accordingly, the present disclosure further provides a method for eliciting an immune response in a vertebrate subject, said method comprising administering to the subject:

(a) an immunogen comprising a polypeptide comprising a C-lobe domain or an N-lobe domain of an HIBP surface receptor protein obtainable from or obtained from a Gram-negative bacterial species wherein the polypeptide is unable to substantially bind host iron binding protein; or (b) an expression vector comprising a polynucleotide encoding an immunogen comprising a polypeptide comprising a C-lobe domain or an N-lobe domain of an HIBP surface receptor polypeptide obtainable from a Gram-negative bacterial species; and wherein the immunogen is administered in, or is expressed in, an amount sufficient to elicit an immune response in the vertebrate subject.

In preferred embodiments, the C-lobe domain or the N-lobe domain comprises a plurality of β-strands connected by a plurality of loop domains, wherein at least one loop domain of the plurality of loop domains has been modified.

The present disclosure further includes an immunogen comprising a C-lobe domain or an N-lobe domain of an HIBP surface receptor polypeptide wherein the C-lobe domain or the N-lobe domain comprises a plurality of β-strands connected by a plurality of loop domains, and wherein at least one loop domain has been modified, for use as a medicament.

The present disclosure further includes an immunogen comprising a C-lobe domain or an N-lobe domain of an HIBP surface receptor used in the prevention of infection, for example by prevention of colonization, or disease by infectious Gram-negative bacteria, including bacteria belonging to the genus *Actinobacillus, Neisseria, Haemophilus, Mannheimia, Histophilus, Pasteurella* or *Moraxella*. In preferred embodiments, the C-lobe domain or the N-lobe domain comprises a plurality of β-strands connected by a plurality of loop domains, wherein at least one loop domain of the plurality of loop domains has been modified.

The present disclosure further includes an immunogen comprising a C-lobe domain and/or an N-lobe domain of an HIBP surface receptor polypeptide for use in the manufacture of a medicament for the prevention of infection or disease by infectious Gram-negative bacteria, including bacteria belonging to the genus *Actinobacillus, Neisseria, Haemophilus, Mannheimia, Histophilus, Pasteurella* or *Moraxella*. In preferred embodiments, the C-lobe domain or the N-lobe domain comprises a plurality of β-strands connected by a plurality of loop domains, wherein at least one loop domain of the plurality of loop domains has been modified.

The immunogenic compositions of the present disclosure may be used to prepare a vaccine. Accordingly, the present disclosure further provides a vaccine composition comprising an antigen derived from a HIBP surface receptor protein from a Gram-negative pathogenic bacterial species, wherein the protein derived from the HIBP surface receptor protein has been modified in such a manner that it is unable to substantially bind host iron binding protein.

In further embodiments, the present disclosure further also includes a vaccine composition comprising a polypeptide comprising a C-lobe domain or an N-lobe domain of an HIBP surface receptor protein obtainable from a Gram-negative pathogenic bacterial species wherein the polypeptide is unable to substantially bind host iron binding protein.

In further embodiments, the vaccine composition comprises a polypeptide comprising a C-lobe domain or an N-lobe domain of an HIBP surface receptor polypeptide wherein the C-lobe domain or the N-lobe domain comprises a plurality of β-strands connected by a plurality of loop domains, and wherein at least one loop domain has been modified and wherein the polypeptide is unable to substantially bind host iron binding protein.

The present disclosure further provides methods for administering a vaccine to a vertebrate subject, the method comprising administering to the subject a vaccine comprising a polypeptide comprising a C-lobe domain or an N-lobe domain of an HIBP surface receptor protein obtainable from a Gram-negative pathogenic bacterial species, wherein the vaccine is administered in an amount sufficient to prevent or treat a disease caused by a Gram-negative bacterial species.

The present disclosure further includes a vaccine comprising a C-lobe domain or an N-lobe domain of an HIBP surface receptor for use in the prevention of infection or disease by infectious Gram-negative bacteria, including bacteria belonging to the genus *Actinobacillus, Neisseria, Haemophilus, Mannheimia, Histophilus, Pasteurella* or *Moraxella*.

In preferred embodiments, the C-lobe domain or the N-lobe domain comprises a plurality of β-strands connected by a plurality of loop domains, and at least one loop domain of the plurality of loop domains has been modified.

Other features and advantages of the present disclosure will become apparent from the following detailed description. It should be understood, however, that the detailed description, while indicating preferred embodiments of the disclosure, are given by way of illustration only, since various changes and modifications within the spirit and scope of the disclosure will become apparent to those of skill in the art from the detailed description.

BRIEF DESCRIPTION OF THE DRAWINGS

The disclosure is in the hereinafter provided paragraphs described in relation to its Figures. The Figures provided herein are provided for illustration purposes and are not intended to limit the present disclosure.

FIG. 5 depicts the nonrandom binding of the TbpB N-lobe (SEQ.ID NO: 8) from *A. pleuropneumoniae* H49 to ELISA plates illustrated by the substantial reduction in binding of labeled transferrin when the purified TbpB protein is used to coat the ELISA plate rather than the fusion protein (i.e. maltose binding protein (Mbp) fused to the TbpB N-lobe) precursor (left portion of Panel A and Panel B). The figure also illustrates how the use of an N-terminal biotinylated peptide overcomes the random binding (right portion of Panel A and Panel B). The left portion of Panel A illustrates the results of an assay using labeled transferrin (Tf) to measure bound purified Mbp-TbpB N-lobe or TbpB N-lobe to regular ELISA plates. The right portion illustrates the results when the recombinant proteins contain a biotinylated N-terminal peptide tag that is used to attach to streptavidin-coated ELISA plates. Panel B is a cartoon illustrating what is believed to occur in the different ELISA wells for the corresponding results shown immediately above in Panel A.

FIG. 10 depicts the sequence diversity of TbpBs from the human pathogen *Neisseria meningitidis*. A subset of tbpB genes sequenced from a collection of over 100 strains combined with a large collection of sequences available in the BIGSDB public database (pubmlst.org/software/database/bigsdb/)—Bacterial Isolate Genome Sequence Database) are represented in this figure. The collection of sequences represents a global collection of isolates over an extended time period of nearly 50 years, and thus this is a fairly comprehensive representation of the overall TbpB diversity. FIG. 10B depicts the sequence diversity of TbpBs C-lobes that were derived from the TbpB sequences. The sequences for TbpB C-lobes from strains indicated by arrows or lines are appended (SEQ.ID NO: 119; SEQ.ID NO: 125; and SEQ.ID NO: 179 to SEQ.ID NO: 195) to provide representative sequences. The two strains indicated by the double-headed arrows were included to provide a more comprehensive representation of the C-lobe diversity but were not available for the analysis of antisera illustrated in FIG. 11.

FIG. 11 depicts the reactivity of antisera directed against truncated intact TbpB (SEQ.ID NO: 148, aa 43-575) and TbpB C-lobe (SEQ.ID NO: 119 aa 342-575) derived from B16B6, a representative isotype I strain of *N. meningitidis*. The antisera were tested in our custom ELISA assay (FIG. 5) against a panel of TbpBs that represent the overall sequence diversity of TbpBs in *N. meningitidis* (arrows, FIG. 10). The panel of TbpBs are from *N. meningitidis* strains B16B6 (SEQ.ID NO: 117), H44/76 (SEQ.ID NO: 133), S3131 (SEQ.ID NO: 132), M990 (SEQ.ID NO: 134), M978 (SEQ.ID NO: 135), M992 (SEQ.ID NO: 138), P3006 (SEQ.ID NO: 139), 120M (SEQ.ID NO: 137), MC58 (SEQ.ID NO: 136) and M982 (SEQ.ID NO: 123). The results demonstrate that the C-lobe antiserum had higher titres than the TbpB antiserum against all of the TbpBs except the TbpBs from B16B6 and H44/76.

FIG. 12 depicts the design and production of a dimer comprised of the TbpB C-lobe from two different strains of the human pathogen *Neisseria meningitidis* (SEQ.ID NO: 299; and SEQ.ID NO: 300). Panel A shows the DNA and protein sequence for the dimer of C-lobes from *N. meningitidis* strains B16B6 (SEQ.ID NO: 303; and SEQ.ID NO: 304) and M982 (SEQ.ID NO: 301; and SEQ.ID NO: 302), in that order. The underline indicates the DNA sequence of the peptide region connecting the individual C-lobes. Panel B illustrates SDS-PAGE analysis of a preparation of the C-lobe dimer compared to preparations of the individual C-lobes from *N. meningitidis* strains M982 and B16B6.

FIG. 14 depicts the reduction of loop domains of the C-lobe of the TbpB polypeptide of *N. meningitidis* M982. In Panel A, structural models of the native C-lobe (SEQ.ID NO: 305) and modified C-lobe (SEQ.ID NO: 306) are shown to illustrate the reduction of the four loops (L18, L21, L23 and L27). In the model on the left hand side (SEQ.ID NO: 305) the loops targeted for reduction are indicated with a dotted black line. The middle model (SEQ.ID NO: 306) illustrates the modified loop domains. In the model on the right hand side, the two prior structures are superimposed to show how the large variable loops have been removed without effecting overall protein structure. Panel B is a polypeptide sequence alignment comparing sequences of the native C-lobe, the engineered C-lobes with those from which a single loop has been modified by the removal of either L18 (SEQ.ID NO: 307), L21 (SEQ.ID NO: 308), L23 (SEQ.ID NO: 309) or L27 (SEQ.ID NO: 310) and the C-lobe in which all four loops (L18, L21, L23 and L27); have been modified (the sequence labeled "loopless"; SEQ.ID NO: 306). The regions of the sequence encompassing the targeted loops are highlighted in grey and the loop number is indicated in grey font.

FIG. 17 depicts the design of hybrid proteins displaying regions of TbpA on the TbpB C-lobe scaffold. Panel A is a structural model of TbpA (SEQ.ID NO: 152) highlighting the regions selected to 'transplant' onto the TbpB C-lobe. The TbpA loop 3 helix, loop 10, loop 11 and plug loop are shown as space-filled regions. Panel B shows an alignment of the native C-lobe (C-lobe) (SEQ.ID NO: 305), the loopless C-lobe scaffold (loopless C) (SEQ.ID NO: 306) and a hybrid protein with the all the regions of TbpA displayed (SEQ.ID NO: 311). In the hybrid protein the TbpA loop 3 helix replaces loop 18 of the TbpB C-lobe, TbpA loop 10 replaces loop 21 of the TbpB C-lobe, TbpA loop 11 replaces loop 23 of the TbpB C-lobe, and the TbpA plug loop replaces loop 27 of the TbpB C-lobe.

FIG. 18 depicts the microbial production of hybrid TbpA-TbpB C-lobes that were produced using the strategy described in FIG. 17. Panel A illustrates the production of the recombinant fusion proteins with an N-terminal maltose binding protein (Mbp) fusion partner and Panel B illustrates the proteins after cleavage with TEV protease. The wild-type (WT) protein is the native M982 C-lobe (SEQ.ID NO: 125) and the Minus Loops is the C-lobe with all four loops removed (SEQ.ID NO: 129) that effectively serves as the scaffold for displaying the TbpA regions. Loop 10 refers to the protein with the extracellular loop region of TbpA inserted into the TbpB C-lobe loop 21 (SEQ.ID NO: 154). Loop 11 refers to the protein with the extracellular loop region of TbpA that was inserted into the TbpB C-lobe loop 23 (SEQ.ID NO: 156). Helix 3 refers to the segment of extracellular loop 3 of TbpA that was inserted into the TbpB C-lobe loop 27 (SEQ.ID NO: 158). Plug loop refers to the region from the plug domain of TbpA that was inserted into the TbpB C-lobe loop 18 (SEQ.ID NO: 160). Protein molecular weight standards (MWS) observed on these gels are 93, 70, 53, 41 and 22.

FIG. 19 depicts the immunogenicity of the modified C-lobe of *N. meningitidis* strain M982 compared to the modified C-lobe with foreign loop regions from TbpA spliced into the modified loop sites. The endpoint titres of mouse antisera were determined with our custom ELISA assay. Mice were either immunized with; (i) the 'loopless' C-lobe with all four loops removed (SEQ.ID NO: 129), (ii) the 'loopless' C-lobe with TbpA loop 10 inserted into the TbpB C-lobe loop 21 (SEQ.ID NO: 154), (iii) the 'loopless' C-lobe with TbpA loop 11 inserted into the TbpB C-lobe loop 23 (SEQ.ID NO: 156), (iv) the 'loopless' C-lobe with TbpA loop 3 helix inserted into the TbpB C-lobe loop 27 (SEQ.ID NO: 158), or (v) the 'loopless' C-lobe with TbpA plug loop inserted into the TbpB C-lobe loop 18 (SEQ.ID NO: 160). The sera were tested against the hybrid TbpA-TbpB antigen in which the 'loopless' C-lobe has all four of the TbpA loops inserted (SEQ.ID NO: 131). The results show that all the hybrid antigens were immunogenic, at least as immunogenic as the loopless' C-lobe.

FIG. 20 depicts the design and production of hybrid proteins displaying regions of LbpA (SEQ.ID NO: 162) on the TbpB C-lobe scaffold. Panel A is a structural model of LbpA highlighting the regions selected to 'transplant' onto the TbpB C-lobe. The LbpA loop 3 helix is colored darker grey and loop 2 is colored black. Panel B shows an alignment of the native C-lobe (C-lobe, SEQ.ID NO: 305), the loopless C-lobe scaffold (loopless C, SEQ.ID NO: 306) and the hybrid protein with the regions of LbpA displayed. In the hybrid protein the LbpA loop 2 replaces loop 21 of the TbpB C-lobe (SEQ.ID NO: 312) the LbpA loop 3 helix replaces loop 18 of the TbpB C-lobe (SEQ.ID NO: 313). Protein molecular weight standards (MWS) observed on these gels are 100, 75, 63, and 48.

FIG. 21 depicts the design of a 'conjugation loop' in the TbpB C-lobe from the human pathogen *Haemophilus influenzae*. Panel A shows the DNA and protein sequence for the gene encoding the hybrid gene with the DNA region encoding the conjugation loop shown in larger font (SEQ.ID NO: 314). The amino acids are shown in single letter code in which lysine is indicated by the letter K, of which there are 42 in the conjugation loop compared to 24 in the entire C-lobe (SEQ.ID NO: 315). Panel B illustrates a structural model of the *H. influenzae* TbpB C-lobe indicating the position for insertion of the conjugation loop. As illustrated, the conjugation loop is inserted into the handle domain of the C-lobe replacing loop L23 of the C-lobe (using the loop nomenclature used throughout this disclosure) (FIG. 2). It is noted that for illustrative purposes the model was created with a conjugation loop of 11 amino acids instead of the 91 in the actual protein.

FIG. 22 depicts the transferrin binding properties of site-directed mutant TbpB proteins derived from recombinant truncated TbpB proteins from *A. pleuropneumoniae*, *A. suis* and *H. parasuis*. The recombinant truncated TbpB proteins were expressed as fusion proteins and tested for binding activity. Recombinant fusion proteins were initially screened for transferrin binding by a solid-phase binding assay and an affinity capture assay. The purified mutant proteins were then evaluated for binding to pTf either by isothermal calorimetry, surface plasmon resonance or biolayer interferometry (23-25). Several of the mutations resulted in a 100 fold increase in the affinity constant (Kd), such as the F171A mutation in the TbpB from *A. pleuropneumoniae* strain H49, the Y174A mutation in the TbpB from *A. pleuropneumoniae* strain H49 or the Y167A or W176A mutations in the TbpB from *H. parasuis* strain HP5. It is interesting to note that these mutants all map to loop 8.

FIG. 23 depicts the enhanced ability of a site-directed mutant protein to induce a protective immune response in the native host. In this figure the ability of the site-directed Y167A TbpB from *H. parasuis* strain HP5 (SEQ.ID NO: 174) is compared to the wild-type TbpB (SEQ.ID NO: 115), and controls including a commercial vaccine (Porcillis Glasser) and adjuvant alone. The pigs were challenged by intratracheal inoculation with $10^8$ colony-forming units (cfus) of the Hp5 (Nagasaki) strain and were monitored for clinical signs and symptoms throughout the duration of the experiment. Animals with severe symptomotology were euthanized prior to the end of the experiment. The graph shows the survival curve from 24 to 108 hrs at 12 hr increments, and then connects to the final time point at 14 days.

FIG. 24 depicts the cellular immune response induced by the native and mutant TbpB antigens. Panel A and Panel B illustrate the B-cell response on the day of challenge (after two IM immunizations) and 4 days (96 hrs) after challenge, respectively. Panel C and Panel D illustrate the T-helper cell response on the day of challenge and 4 days after challenge. The diamonds, triangles and squares represent pigs immunized with native TbpB, the Y167A mutant TbpB and the Porcilis Glasser (PG) vaccine, respectively. There are reduced numbers of samples for the native TbpB and PG vaccine treated pigs on the 4th day after challenge. The analysis was performed by FACS analysis with peripheral blood mononuclear cells. Significant differences between groups: *$p<0.05$, *** $p<0.001$.

FIG. 25 depicts that immunization with recombinant truncated TbpB, recombinant truncated TbpB N-lobe or recombinant TbpB C-lobe from *N. meningitidis* provides protection from colonization in a humanized transgenic mouse model. In the experiment illustrated in Panel A, transgenic C57 black mice expressing the human CEACAM1 receptor were immunized with recombinant truncated TbpB from *N. meningitidis* strain M982 or with adjuvant alone on day 1 and day 21. Mice were subjected to intranasal inoculation with approximately $1\times10^7$ CFU of *N. meningitidis* strain M982 on day 35. The squares and circles represent the CFU recovered from individual mice 3 days after challenge (day 38). Panel B illustrates a follow up experiment in which mice were immunized either with recombinant truncated TbpB, recombinant truncated TbpB N-lobe, recombinant TbpB C-lobe, recombinant factor H binding protein or adjuvant alone on day 1 and day 21. As in Panel A, the number of CFUs of *N. meningitidis* strain M982 recovered 3 days after challenge in individual mice are plotted on the graph.

FIG. 26 depicts the sequence diversity of TbpBs and TbpB G-lobes from the human pathogen *Neisseria gonorrhoeae*. Panel A (FIG. 26A) illustrates the sequence diversity of the intact TbpBs and Panel A (FIG. 26B) represents the sequence diversity for the TbpB C-lobes. Sequences for representative *N. meningitidis* TbpBs and TbpB C-lobes (FIG. 10, arrows and double arrows) were included in this analysis to determine to what extent the sequences for TbpBs and TbpB C-lobes from *N. gonorrhoeae* is a subset of the sequence diversity of that present in *N. meningitidis*. As for FIG. 10, representative *N. gonorrhoeae* TbpB sequences (SEQ ID NO: 207 to SEQ ID NO: 212) and TbpB C-lobe sequences (SEQ ID NO: 213 to SEQ ID NO: 218) indicated by arrows are included in appendix to provide a representation of the overall sequence diversity. As illustrated in Panel A there are two clusters of *N. gonorrhoeae* TbpBs that are sub-branches of meningococcal isotype 2 TbpBs. There is one larger cluster most closely related to TbpB from meningococcal strain H44/76 and a smaller cluster most closely related to TbpB from strain P3306. The C-lobe tree in Panel B reveals that the *N. gonorrhoeae* TbpB C-lobes form a distinct cluster from the meningococcal TbpB C-lobes that are most closely related to the meningococcal isotype 2 TbpBs.

FIG. 27 depicts the sequence diversity of TbpBs and TbpB C-lobes from the human pathogen *Haemophilus influenzae*. Panel A (FIG. 27A) illustrates the sequence diversity of the intact TbpBs and Panel B (FIG. 26B) represents the sequence diversity for the TbpB C-lobes. Representative *H. influenzae* TbpB sequences (SEQ ID NO: 196-204) indicated by arrows are included in the appendix to provide a representation of the overall sequence diversity. As illustrated in Panel A there are three main clusters (groups) of *H. influenzae* TbpBs that include type b and non-typeable *H. influenzae* strains intermixed, indicating that the TbpB diversity is not linked to any other attribute such as presence of capsule. There are also three main groups of C-lobe diversity.

FIG. 28 depicts the sequence diversity of TbpBs amongst the ruminant pathogens *Mannheimia haemolytica, Mannheimia glucosida* and *Bibersteinia trehalosi* (also known to the art as *Pasteurella haemolytica* and *P. trehalosi*, respectively). Arrows indicate representative sequences included in the SEQ.ID NO: listing.

FIG. 29 depicts the sequence diversity of TbpBs from *Moraxella catarrhalis*. Arrows indicate the representative sequences of TbpBs from the three main clusters that are included in the SEQ.ID NO: listing.

FIG. 30 depicts an illustrative phylogenetic tree.

TABLES 1-3 represent combinations of 1, 2 or 3 loop domains, respectively, selected from the loop domains L1-L32 of HIBP polypeptides, which may be modified in accordance with the present disclosure.

☑ signifies a loop domain or combination of loop domains that may be modified in accordance with certain embodiments of the current disclosure.

☒ signifies a non-permitted combination of loop domains in accordance with certain embodiments of the current disclosure.

☐ signifies a combination of permitted loop domains, displayed however by a ☑ elsewhere in the same table, in accordance with certain embodiments of the current disclosure.

DETAILED DESCRIPTION OF THE DISCLOSURE

Figure 1:
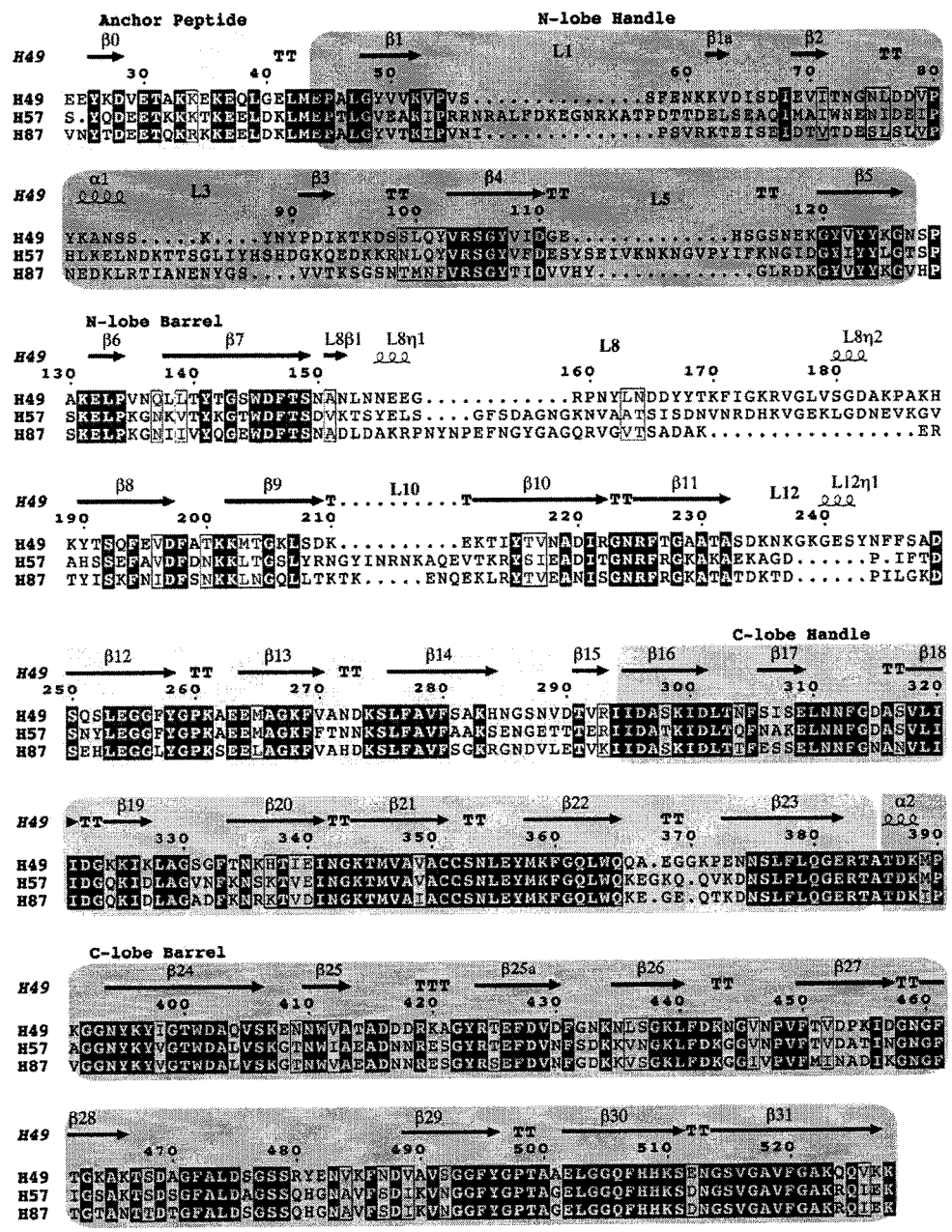
FIG. 1 depicts an alignment of the polypeptide sequences of several TbpBs, notably ApH49 TbpB (SEQ.ID NO: 296), ApH87 TbpB (SEQ.ID NO: 297), and AsH57TbpB (SEQ.ID NO: 298), from porcine TbpB pathogens and structural models of the proteins (pdb 3HOL, 3PQS and 3PQU, respectively). These three proteins provide a good representation of the sequence diversity amongst TbpBs from porcine pathogens (FIG. 4, large black arrows). The upper panel illustrates the polypeptide sequence alignment, whereas the lower panel illustrates the structural models. In the sequence alignment the domain structure is demarked by background shading and labeled accordingly. The secondary structural elements are illustrated and nomenclature and numbering for the β-strands ("β1"-"β31") and loops (L1-L32) are illustrated immediately above the aligned sequences. The subregions for loop 8 (8a; 8b; and 8c) in this figure are referred to due to the large size of loop 8, differences between TbpB variants and secondary structural elements in some loop variants. Further indicated are the C-lobe and N-lobe cap areas labeled as "C-lobe Cap Area" and "N-lobe Cap Area", respectively and the C-lobe handle and N-lobe handle areas labeled as "C-lobe handle" and "N-lobe handle" areas, respectively. The structural models for the three TbpBs (ApH49 TbpB (FIG. 1A); ApH87 TbpB (FIG. 1B), and AsH57 TbpB (FIG. 1C)) in the alignment in the upper panel are depicted in the bottom panel and the domains are labeled for the third structural model (AsH57TbpB), which is depicted in an identical orientation as the other two models.

Various compositions and methods will be described below to provide an example of an embodiment of each claimed subject matter. No embodiment described below limits any claimed subject matter and any claimed subject matter may cover methods, processes, compositions or systems that differ from those described below. The claimed subject matter is not limited to compositions or methods having all of the features of any one composition, method, system or process described below or to features common to multiple or all of the compositions, systems or methods described below. It is possible that a composition, system, method or process described below is not an embodiment of any claimed subject matter. Any subject matter disclosed in a composition, system, method or process described below that is not claimed in this document may be the subject matter of another protective instrument, for example, a continuing patent application, and the applicants, inventors or owners do not intend to abandon, disclaim or dedicate to the public any such subject matter by its disclosure in this document.

It should be noted that terms of degree such as "substantially", "essentially" "about" and "approximately" as used herein mean a reasonable amount of deviation of the modified term such that the end result is not significantly changed. These terms of degree should be construed as including a deviation of the modified term if this deviation would not negate the meaning of the term it modifies.

As used herein, the wording "and/or" is intended to represent an inclusive-or. That is, "X and/or Y" is intended to mean X or Y or both, for example. As a further example, "X, Y, and/or Z" is intended to mean X or Y or Z or any combination thereof.

All publications, patents and patent applications are herein incorporated by reference in their entirety to the same extent as if each individual publication.

As hereinbefore mentioned, the present disclosure provides novel immunogenic compositions, and in particular immunogenic compositions based on the HIBP surface receptor proteins from Gram-negative pathogenic bacterial species, such as *Neisseria meningitidis*. The immunogenic compositions of the present disclosure are useful in that they may be employed to prepare novel vaccine formulations to protect humans and animals against infective pathogenic Gram-negative bacterial species. In accordance with the present disclosure, the HIBP surface receptor proteins of the present disclosure are modified in such a manner that they are unable to substantially bind host iron binding proteins. Such modified HIBP surface receptor proteins exhibit unexpectedly strong immunogenic properties. Furthermore the immunogenic compositions of the present disclosure are substantially stable polypeptides and therefore may readily be manufactured. Moreover, and importantly, the immunogenic compositions of the present disclosure are unexpectedly effective, for example by inducing a cross-reactive immune response, thus permitting protection against multiple pathogenic microbial organisms by the administration of a single efficacious vaccinating compound. The vaccines prepared in accordance with the present disclosure do not contain live organisms or crude extracts, thereby representing a very limited health risk.

Accordingly, the present disclosure provides, in at least one embodiment, an immunogenic composition comprising an HIBP surface receptor protein from a Gram-negative pathogenic bacterial species, wherein the HIBP surface receptor protein has been modified in such a manner that it is unable to substantially bind host iron binding protein.

The present disclosure further provides an immunogenic composition comprising a polypeptide comprising a C-lobe domain or an N-lobe domain of an HIBP surface receptor protein obtainable from a Gram-negative pathogenic bacterial species, wherein the polypeptide is unable to substantially bind host iron binding protein. In certain embodiments, the N-lobe domain or the C-lobe domain of the HIBP surface receptor protein comprises a plurality of β-strands connected by a plurality of loop domains, and one of more loop domains of the plurality of loop domains has been modified.

Terms and Definitions

Unless defined otherwise, all technical and scientific terms used herein have the same meaning as commonly understood by one of ordinary skill in the art to which the disclosure pertains. All patents and patent applications, and other publications, including nucleic acid and polypeptide sequences from GenBank, SwissPro and other databases, cited herein, whether supra or infra, are hereby incorporated by reference in their entirety, where permitted. It is further noted that, as used in this specification and the appended claims, the singular forms "a", "an", and "the" include plural referents unless the content clearly dictates otherwise. Thus, for example, reference to "an immunogen" includes a mixture of two or more such agents, reference to "a polypeptide" includes reference to mixtures of two or more polypeptides, reference to "a cell" includes two or more such cells, and the like.

The terms "immunogen" and "immunogenic composition", as interchangeably used herein, are used in their broadest sense to refer to a molecule which contains one or more epitopes that will stimulate the immune response in a host organism to generate a cellular immunogen-specific immune response, and/or a humoral antibody response. Immunogens include nucleic acids, proteins, polypeptides, peptides and immunogenic protein fragments.

The terms "vaccine" and "vaccine composition", as interchangeably used herein, refer to any pharmaceutical composition containing an immunogen, which composition can be used to prevent or treat a disease or condition in a subject. The terms thus encompass subunit vaccines, i.e., vaccine compositions containing immunogens which are separate and discrete from a whole organism with which the immunogen is associated in nature.

The term "vertebrate subject" refers to any member of the subphylum cordata, particularly mammals, including, without limitation, humans and other primates. The term does not denote a particular age. Thus both newborn, infant, child and adult individuals are intended to be covered.

The interchangeably herein used terms "HIBP surface receptor protein", "HIBP surface receptor polypeptide", "host iron binding protein surface receptor protein" or "host iron binding protein surface polypeptide" refer to any membrane anchored protein or polypeptide obtainable from a Gram-negative bacterial species capable of interacting with host iron-binding proteins. The term includes, any TbpB and LbpB proteins. HIBP surface receptor proteins when folded in their native three-dimensional structure, are comprised of a bi-lobal structure comprising an N-lobe domain and a C-lobe domain, the N-lobe domain and the C-lobe domain each comprising a plurality of β-strands assembled in a β-barrel, and a plurality of β-strands assembled in a β-sheet structure adjacent to the β-barrel, referred to as the handle domain, wherein the β-strands are connected by a plurality of loop domains (as further illustrated in FIG. 1). The terms further refer to any and all HIBP surface receptor polypeptide sequences including all bacterial HIBP surface receptor polypeptides, including, without limitation, those set forth in SEQ.ID NO: 2; SEQ.ID NO: 12; SEQ.ID NO: 28; SEQ.ID NO: 107 to SEQ.ID NO: 115; SEQ ID NO: 117; SEQ.ID NO: 123; SEQ.ID NO: 131 to SEQ.ID NO: 147; SEQ.ID NO: 177; SEQ.ID NO: 178; SEQ.ID NO: 196 to SEQ.ID NO: 204; SEQ.ID NO: 206 to SEQ.ID NO: 212; and SEQ.ID NO: 219 to SEQ.ID NO: 228, and those comprising a sequence of amino acid residues which (i) are substantially identical to the amino acid sequences constituting any HIBP surface receptor protein set forth herein; (ii) are encoded by a nucleic acid sequence capable of hybridizing under at least moderately stringent conditions to any nucleic acid sequence encoding any HIBP surface receptor protein set forth herein or capable of hybridizing under at least moderately stringent conditions to any nucleic acid sequence encoding any HIBP surface receptor protein set forth herein, but for the use of synonymous codons. The terms further include any HIBP surface receptor protein precursor polypeptide; or (iii) will use transferrin binding proteins, lactoferrin binding proteins or their subdomains as templates when submitted to a structural modeling server such as Phyre2 (www.sgb.bio.ic-.ca.uk/phyre2/) or Swiss-Model (swissmodel.expasy.org/), in the latter selecting automated mode. The terms further include mature TbpB polypeptides as well as any HIBP surface receptor polypeptide precursor, including any pre-HIBP surface receptor polypeptide precursor, or HIBP surface receptor polypeptide precursor comprising an N-terminal or other signal sequence.

The interchangeably herein used terms "integral outer membrane protein" and "IOM protein" refer to any integral outer membrane protein from Gram-negative bacterial species, including any proteins belonging to the TonB dependent subclass of proteins, which when folded in their native 3 dimensional structure comprise a 22-stranded C-terminal beta-barrel domain and N-terminal plug or cork domain capable of filling a channel in the C-terminal beta-barrel domain. The term includes without limitation and TbpA and LbpA protein. The terms further refer to any and all IOM polypeptide sequences including all including those set forth in SEQ.ID NO: 152; and SEQ.ID NO: 162 and those comprising a sequence of amino acid residues which (i) are substantially identical to the amino acid sequences constituting any IOM protein set forth herein; (ii) are encoded by a nucleic acid sequence capable of hybridizing under at least moderately stringent conditions to any nucleic acid sequence encoding any IOM protein set forth herein or capable of hybridizing under at least moderately stringent conditions to any nucleic acid sequence encoding any IOM protein set forth herein, but for the use of synonymous codons. The terms further include any IOM protein precursor polypeptide; or (iii) will use 3V8X or their subdomains as templates when submitted to a structural modeling server such as Phyre2 (http://www.sbg.bio.ic.ac.uk/phyre2/) or Swiss-Model (http://swissmodel.expasy.org/), in the latter selecting automated mode.

The term "N-lobe domain" as used herein refers to the N-terminal portion of a HIBP surface receptor protein comprising a plurality of β-strands connected by a plurality of loop domains, wherein some of the β-strands are configured to form a β-barrel and an adjacent β-sheet structure, termed a handle domain (see: FIG. 1; amino acid residue 46 to amino acid residue 342). The term N-lobe domain further includes, without limitation all polypeptides having the sequence set forth in SEQ.ID NO: 8; SEQ.ID NO: 10; SEQ.ID NO: 24; SEQ.ID NO: 26; SEQ.ID NO: 36; SEQ.ID NO: 38; SEQ.ID NO: 121; SEQ.ID NO: 127; SEQ.ID NO: 229; SEQ.ID NO: 231; and SEQ.ID NO: 233.

Figure 2:
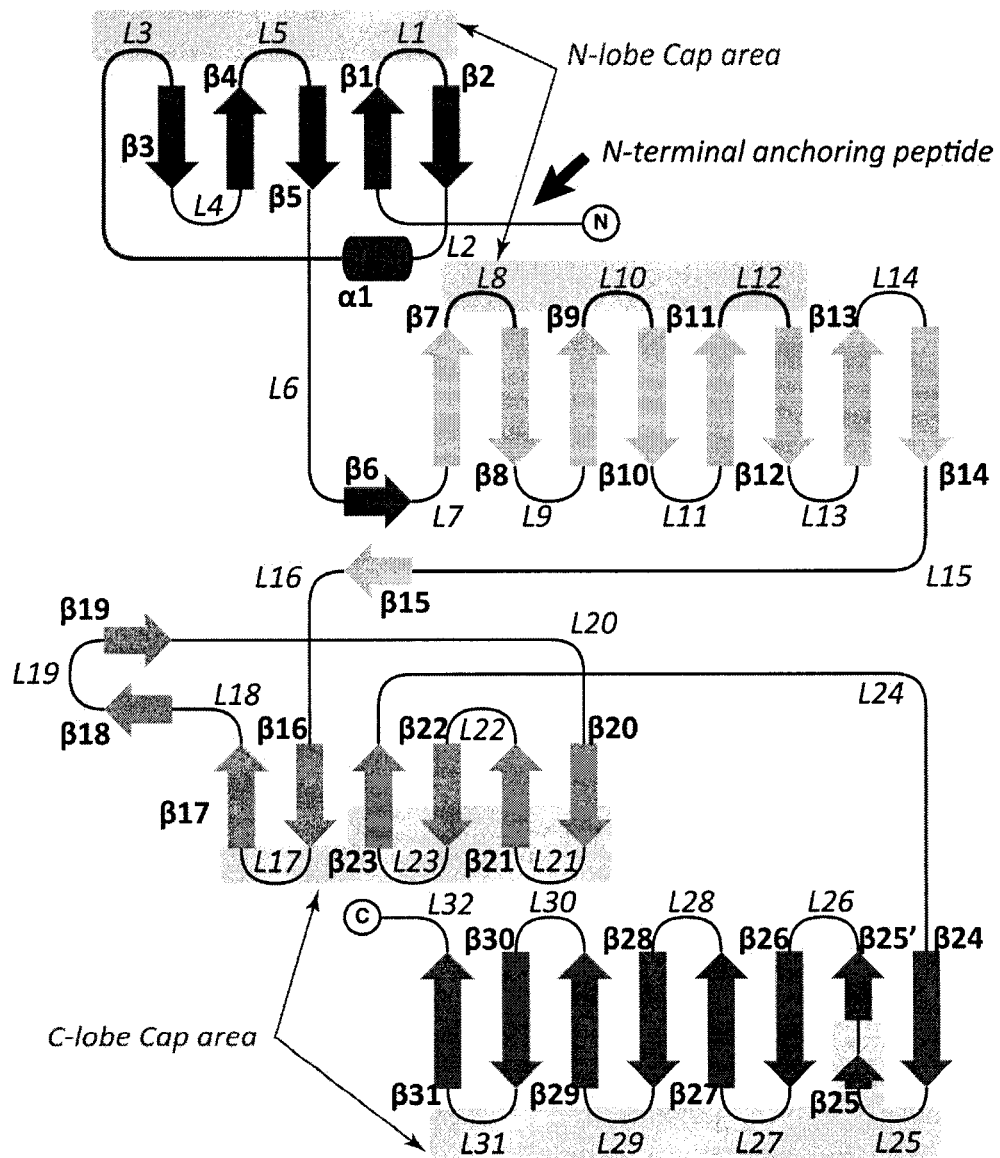
FIG. 2 depicts a schematic drawing of certain secondary structural features of the amino acid sequence of a TbpB polypeptide with the recommended nomenclature for this class of proteins. The N and C-termini of the polypeptide are indicated and labeled "N" and "C" respectively. The β-strands are indicated by arrows and sequentially labeled starting from the N-terminus "β1" to "β31". The loop domains are indicated and labeled "L1" to "L32". The sequences of the loops of the TbpB polypeptide from *A. pleuropneumoniae* Strain H49 TbpB (SEQ.ID NO: 2) are included in this patent application (SEQ.ID NO: 41 to SEQ.ID NO: 106). Further indicated are the C-lobe and N-lobe cap areas labeled as C-lobe Cap Area and N-lobe Cap Area, respectively, and the C-lobe handle and N-lobe handle areas labeled as "C-lobe handle" and "N-lobe handle" areas.

The term "C-lobe domain" as used herein refers to the C-terminal portion of a HIBP surface receptor protein comprising a plurality of β-strands connected by a plurality of loop domains, wherein some of the β-strands are configured to form a β-barrel and an adjacent β-sheet structure termed a handle domain. Referring further to FIG. 1 and FIG. 2, the C-lobe handle domain is the contiguous polypeptide domain from β-strand 16 onwards and up to and including β-strand 23 which, in the case of the in FIG. 2 depicted ApH49, ApH57 and ApH87 TbpB polypeptides, consists of amino acid residues 344 to 431, and in SEQ.ID. NO: 2 from amino acid residue 314 to amino acid residue 401 (ApH 49), in SEQ.ID. NO: 27 from amino acid residue 363 to amino acid residue 450 (ApH 57), and in SEQ.ID. NO: 12 from amino acid residue 315 to amino acid residue 401 (ApH 87). The C-lobe β-barrel domain is the contiguous polypeptide domain from β-strand 23 onwards through to the C-terminus of the polypeptide, which, in the case of the in FIG. 2 depicted ApH49, ApH57 and ApH87 TbpB polypeptides, is the polypeptide chain from amino acid reside 443 onwards and up to the C-terminus, and in SEQ.ID. NO: 2 from amino acid residue 413 onwards (ApH 49), in SEQ.ID. NO: 27 from amino acid residue 462 onwards (ApH 57), and in SEQ.ID. NO: 12 from amino acid residue 413 onwards. It is noted that the C-lobe handle domain and the C-lobe 3-barrel domain may be connected by a short loop (denoted as "L24" in FIG. 1 and FIG. 2) It is further noted that the term C-lobe domain, as used herein, is specifically intended to include, not only the C-lobe β-barrel domain, but also the handle domain forming a β-sheet structure, comprised typically of approximately 90 or more amino acid residues, and located N-terminally relative to the C-lobe β-barrel structure. The term C-lobe domain, as used herein, further includes, without limitation all polypeptides set forth in SEQ.ID NO: 5; SEQ.ID NO: 6; SEQ.ID NO: 22; SEQ.ID NO: 33; SEQ.ID NO: 34; SEQ.ID NO: 119; SEQ.ID NO: 125; SEQ.ID NO: 179 to SEQ.ID NO: 195; SEQ.ID NO: 213 to SEQ.ID NO: 218; SEQ.ID NO: 230; SEQ.ID NO: 232; SEQ.ID NO: 234 to SEQ.ID NO: 278; and SEQ.ID NO: 288 to SEQ.ID NO: 292.

The term "loop domain" refers to the polypeptide sequences in a HIBP surface receptor protein that connect two β-strands. These polypeptide sequences may vary considerably in length from several amino acid residues to 150 or more amino acid residues.

The terms "TbpB", "TbpB protein", "TbpB polypeptide", as interchangeably used herein, refer to any and all transferrin binding protein B sequences, including all bacterial TbpB polypeptides and polypeptides comprising a sequence of amino acid residues which is (i) substantially identical to the amino acid sequences constituting any TbpB polypeptides set forth herein, including, without limitation, SEQ.ID NO: 2; SEQ.ID NO: 12; SEQ.ID NO: 28; SEQ.ID NO: 107 to SEQ.ID NO: 115; SEQ ID NO: 117; SEQ.ID NO: 123; SEQ.ID NO: 131 to SEQ.ID NO: 147; SEQ.ID NO: 177; SEQ.ID NO: 178; SEQ.ID NO: 196 to SEQ.ID NO: 204; SEQ.ID NO: 206 to SEQ.ID NO: 212; and SEQ.ID NO: 219 to SEQ.ID NO: 228, or (ii) encoded by a nucleic acid sequence capable of hybridizing under at least moderately stringent conditions to any nucleic acid sequence encoding any TbpB polypeptide set forth herein or capable of hybridizing under at least moderately stringent conditions to any nucleic acid sequence encoding any TbpB polypeptide set forth herein, but for the use of synonymous codons. The terms further include mature TbpB polypeptides as well as any TbpB precursor, including any pre-TbpB, or TbpB comprising an N-terminal or other signal sequence.

The terms "LbpB", "LbpB protein", "LbpB polypeptide", as interchangeably used herein, refer to any and all lactoferrin binding protein B sequences including all bacterial LbpB polypeptides and a polypeptides comprising a sequence of amino acid residues which is (i) substantially identical to the amino acid sequences constituting any LbpB polypeptides set forth herein, including, without limitation, SEQ.ID NO: 285 or (ii) encoded by a nucleic acid sequence capable of hybridizing under at least moderately stringent conditions to any nucleic acid sequence encoding any LbpB polypeptide set forth herein or capable of hybridizing under at least moderately stringent conditions to any nucleic acid sequence encoding any LbpB polypeptide set forth herein, but for the use of synonymous codons. The terms further include any LbpB precursor, including pre-LbpB.

The terms "TbpA", "TbpA protein", "TbpA polypeptide", as interchangeably used herein, refer to any and all transferrin binding protein A sequences including all bacterial TbpA polypeptides and polypeptides comprising a sequence of amino acid residues which is (i) substantially identical to the amino acid sequences constituting any TbpA polypeptides set forth herein, including, without limitation, SEQ.ID NO: 152 or (ii) encoded by a nucleic acid sequence capable of hybridizing under at least moderately stringent conditions to any nucleic acid sequence encoding any TbpA polypeptide set forth herein or capable of hybridizing under at least moderately stringent conditions to any nucleic acid sequence encoding any TbpA polypeptide set forth herein, but for the use of synonymous codons. The terms further include any TbpA precursor, including pre-TbpA.

The terms "LbpA", "LbpA protein", "LbpA polypeptide", as interchangeably used herein, refer to any and all lactoferrin binding protein A sequences including all bacterial LbpA polypeptides and a polypeptides comprising a sequence of amino acid residues which is (i) substantially identical to the amino acid sequences constituting any LbpA polypeptides set forth herein, including, without limitation, SEQ.ID NO: 162, or (ii) encoded by a nucleic acid sequence capable of hybridizing under at least moderately stringent conditions to any nucleic acid sequence encoding any LbpA polypeptide set forth herein or capable of hybridizing under at least moderately stringent conditions to any nucleic acid sequence encoding any LbpA polypeptide set forth herein, but for the use of synonymous codons. The terms further include any LbpA precursor, including pre-LbpA.

The term "nucleic acid sequence" as used herein refers to a sequence of nucleoside or nucleotide monomers consisting of naturally occurring bases, sugars and intersugar (backbone) linkages. The term also includes modified or substituted sequences comprising non-naturally occurring monomers or portions thereof. The nucleic acid sequences of the present disclosure may be deoxyribonucleic acid sequences (DNA) or ribonucleic acid sequences (RNA) and may include naturally occurring bases including adenine, guanine, cytosine, thymidine and uracil. The sequences may also contain modified bases. Examples of such modified bases include aza and deaza adenine, guanine, cytosine, thymidine and uracil, and xanthine and hypoxanthine.

The herein interchangeably used terms "nucleic acid sequence encoding a HIBP surface receptor protein" and "nucleic acid sequence encoding a HIBP surface receptor polypeptide", refer to any and all nucleic acid sequences encoding a HIBP surface receptor protein, including any HIBP surface receptor protein and any nucleic acid sequences that encode HIBP surface receptor protein precursors, including, without limitation, those set forth in SEQ.ID NO: 1; SEQ.ID NO: 11; SEQ.ID NO: 27; SEQ.ID NO: 116; SEQ.ID NO: 122; and SEQ.ID NO: 173. As used herein "HIBP surface receptor protein precursor" refers to a HIBP surface receptor protein molecule additionally comprising an N-terminal signal sequence which facilitates export of the polypeptide chain across the cytoplasmic membrane. Nucleic acid sequences encoding a HIBP surface receptor protein further include any and all nucleic acid sequences which (i) encode polypeptides that are substantially identical to the HIBP surface receptor proteins sequences set forth herein; or (ii) hybridize to any HIBP surface receptor protein nucleic acid sequences set forth herein under at least moderately stringent hybridization conditions or which would hybridize thereto under at least moderately stringent conditions but for the use of synonymous codons.

The herein interchangeably used terms "nucleic acid sequence encoding an IOM protein" and "nucleic acid sequence encoding an IOM polypeptide", refer to any and all nucleic acid sequences encoding an IOM protein, including any IOM protein and any nucleic acid sequences that encode IOM protein precursors, including, without limitation, those set forth in SEQ.ID NO: 151 and SEQ.ID NO: 161. As used herein "IOM protein precursor" refers to an IOM protein molecule additionally comprising an N-terminal signal sequence which facilitates export of the polypeptide chain across the cytoplasmic membrane. Nucleic acid sequences encoding a IOM protein further include any and all nucleic acid sequences which (i) encode polypeptides that are substantially identical to the IOM proteins sequences set forth herein; or (ii) hybridize to any IOM protein nucleic acid sequences set forth herein under at least moderately stringent hybridization conditions or which would hybridize thereto under at least moderately stringent conditions but for the use of synonymous codons.

The herein interchangeably used terms "nucleic acid sequence encoding TbpB"; "nucleic acid sequence encoding a TbpB polypeptide", refer to any and all nucleic acid sequences encoding a TbpB polypeptide, including any TbpB polypeptide, including, without limitation, the sequences set forth in SEQ.ID NO: 1; SEQ.ID NO: 11; SEQ.ID NO: 27; SEQ.ID NO: 116; SEQ.ID NO: 122; and SEQ.ID NO: 173, and further including any nucleic acid sequences that encode TbpB precursors. As used herein "TbpB precursor" refers to a TbpB molecule additionally comprising an N-terminal signal sequence which facilitates export of the polypeptide chain across the cytoplasmic membrane. Nucleic acid sequences encoding a TbpB polypeptide further include any and all nucleic acid sequences which (i) encode polypeptides that are substantially identical to the TbpB polypeptide sequences set forth herein; or (ii) hybridize to any TbpB nucleic acid sequences set forth herein under at least moderately stringent hybridization conditions or which would hybridize thereto under at least moderately stringent conditions but for the use of synonymous codons.

The herein interchangeably used terms "nucleic acid sequence encoding LbpB"; "nucleic acid sequence encoding a LbpB polypeptide", refer to any and all nucleic acid sequences encoding a LbpB polypeptide, including any LbpB polypeptide, including, without limitation the sequence set forth in SEQ.ID NO: 284 and any nucleic acid sequences that encode LbpB precursors. As used herein "LbpB precursor" refers to a LbpB molecule additionally comprising an NI-terminal signal sequence which facilitates export of the polypeptide chain across the cytoplasmic membrane. Nucleic acid sequences encoding a LbpB polypeptide further include any and all nucleic acid sequences which (i) encode polypeptides that are substantially identical to the LbpB polypeptide sequences set forth herein; or (ii) hybridize to any LbpB nucleic acid sequences set forth herein under at least moderately stringent hybridization conditions or which would hybridize thereto under at least moderately stringent conditions but for the use of synonymous codons.

The herein interchangeably used terms "nucleic acid sequence encoding TbpA"; "nucleic acid sequence encoding a TbpA polypeptide", refer to any and all nucleic acid sequences encoding a TbpA polypeptide, including any TbpA polypeptide, including, without limitation, the nucleic acid sequence set forth in SEQ.ID NO: 151, and any nucleic acid sequences that encode TbpA precursors. As used herein "TbpA precursor" refers to a TbpA molecule additionally comprising an N-terminal signal sequence which facilitates export of the polypeptide chain across the cytoplasmic membrane. Nucleic acid sequences encoding a TbpA polypeptide further include any and all nucleic acid sequences which (i) encode polypeptides that are substantially identical to the TbpA polypeptide sequences set forth herein; or (ii) hybridize to any TbpA nucleic acid sequences set forth herein under at least moderately stringent hybridization conditions or which would hybridize thereto under at least moderately stringent conditions but for the use of synonymous codons.

The herein interchangeably used terms "nucleic acid sequence encoding LbpA"; "nucleic acid sequence encoding a LbpA polypeptide", refer to any and all nucleic acid sequences encoding a LbpA polypeptide, including any LbpA polypeptide, including, without limitation, the nucleic acid sequence set forth in SEQ.ID NO: 161 and any nucleic acid sequences that encode LbpA precursors. As used herein "LbpA precursor" refers to a LbpA molecule additionally comprising an N-terminal signal sequence which facilitates export of the polypeptide chain across the cytoplasmic membrane. Nucleic acid sequences encoding a LbpA polypeptide further include any and all nucleic acid sequences which (i) encode polypeptides that are substantially identical to the LbpA polypeptide sequences set forth herein; or (ii) hybridize to any LbpA nucleic acid sequences set forth herein under at least moderately stringent hybridization conditions or which would hybridize thereto under at least moderately stringent conditions but for the use of synonymous codons.

By the term "substantially identical" it is meant that two polypeptide sequences preferably are at least 50% identical, and more preferably are at least 85% identical and most preferably at least 95% identical, for example 96%, 97%, 98% or 99% identical. In order to determine the percentage of identity between two polypeptide sequences the amino acid sequences of such two sequences are aligned, using for example the alignment method of Needleman and Wunsch (26), as revised by Smith and Waterman (27) so that the highest order match is obtained between the two sequences and the number of identical amino acids is determined between the two sequences. A preferred, broadly applicable, method for accurately aligning two polypeptides involves the Clustal W algorithm (28) employed with the BLOSUM 62 scoring matrix (29) using a gap opening penalty of 10 and a gap extension penalty of 0.1. This enables identification of high scoring alignments between two sequences, wherein at least 50% of the total length of one of the two sequences is involved in the alignment. Methods to calculate the percentage identity between two aligned amino acid sequences are generally art recognized and include, for example, those described by Carillo and Lipton (30) and those described in Computational Molecular Biology, Lesk, e.d. Oxford University Press, New York, 1988, Biocomputing: Informatics and Genomics Projects. Generally, computer programs will be employed for such calculations. Computer programs that may be used in this regard include, but are not limited to, GCG (31) BLASTP, BLASTN and FASTA (32).

By "at least moderately stringent hybridization conditions" it is meant that conditions are selected which promote selective hybridization between two complementary nucleic acid molecules in solution. Hybridization may occur to all or a portion of a nucleic acid sequence molecule. The hybridizing portion is typically at least 15 (e.g. 20, 25, 30, 40 or 50) nucleotides in length. Those skilled in the art will recognize that the stability of a nucleic acid duplex, or hybrids, is determined by the Tm, which in sodium containing buffers is a function of the sodium ion concentration and temperature (Tm=81.5° C.−16.6 (Log 10 [Na+])+0.41(% (G+C)−600/l), or similar equation). Accordingly, the parameters in the wash conditions that determine hybrid stability are sodium ion concentration and temperature. In order to identify molecules that are similar, but not identical, to a known nucleic acid molecule a 1% mismatch may be assumed to result in about a 1° C. decrease in Tm, for example if nucleic acid molecules are sought that have a >95% identity, the final wash temperature will be reduced by about 5° C. Based on these considerations those skilled in the art will be able to readily select appropriate hybridization conditions. In preferred embodiments, stringent hybridization conditions are selected. By way of example the following conditions may be employed to achieve stringent hybridization: hybridization at 5× sodium chloride/sodium citrate (SSC)/5×Denhardt's solution/1.0% SDS at Tm (based on the above equation)−5° C., followed by a wash of 0.2×SSC/0.1% SDS at 60° C. Moderately stringent hybridization conditions include a washing step in 3×SSC at 42° C. It is understood however that equivalent stringencies may be achieved using alternative buffers, salts and temperatures. Additional guidance regarding hybridization conditions may be found in: Green and Sambrook, Molecular Cloning, a Laboratory Manual, Cold Spring Harbor Laboratory Press, 2012 (33).

The term "chimeric" as used herein in the context of nucleic acid sequences refers to at least two linked nucleic acid sequences which are not naturally linked. Chimeric nucleic acid sequences include linked nucleic acid sequences of different natural origins. For example, a nucleic acid sequence constituting a bacterial promoter linked to a nucleic acid sequence of a TbpB polypeptide or a HIBP surface receptor protein is considered chimeric, and a nucleic acid sequence encoding a TbpB polypeptide from which certain portions have been removed and replaced with portions of a TbpA polypeptide is considered chimeric. Chimeric nucleic acid sequences also may comprise nucleic acid sequences of the same natural origin, provided they are not naturally linked. For example a nucleic acid sequence constituting a promoter obtained from a particular cell-type may be linked to a nucleic acid sequence encoding a polypeptide obtained from that same cell-type, but not normally linked to the nucleic acid sequence constituting the promoter. Chimeric nucleic acid sequences also include nucleic acid sequences comprising any naturally occurring nucleic acid sequence linked to any non-naturally occurring nucleic acid sequence.

By the term "substantially unable to bind host iron binding protein" it is meant that the ability of the host iron binding protein to bind to the HIBP surface receptor protein is diminished in such a manner that the value of the binding constant (Kd) or dissociation constant of the binding interaction between the native host iron binding protein (i.e. the host iron binding protein present in the host organism) and the modified HIBP surface receptor protein is at least 10× higher than the value of the binding constant of the binding interaction between the native host iron binding protein and its complementary native HIBP surface receptor protein. In other words, the modified proteins have a 10× lower affinity for binding native host iron binding protein than the native receptor protein. In preferred embodiments, the relative affinity for binding native host iron binding protein by the modified protein is 30× lower than that of the native HIBP surface receptor protein, and, in most preferred embodiments, the relative affinity for binding native host iron binding protein by the modified protein is 100× lower than that of the native HIBP surface receptor protein. In further preferred embodiments, the binding constant between the modified HIBP surface receptor protein and the native host iron binding protein is at least 300 nM. Preferably the binding constant is at least 500 nM, and most preferably at least 1 µM.

The term "substantially free" as used herein is a term of degree meaning that a composition does not contain significant amounts of a compound of which the composition is said to be substantially free of. When a composition is substantially free of a compound, for example substantially free of N-lobe domain, such composition comprises preferably less than 5.0% of such compound, more preferably less than 1.0% of such compound, and most preferably less than 0.1% of such compound.

Immunogenic Compositions

As hereinbefore mentioned, the present disclosure provides, in at least one embodiment, an immunogenic composition comprising an HIBP surface receptor protein from a Gram-negative pathogenic bacterial species, wherein the HIBP surface receptor protein has been modified in such a manner that it is unable to substantially bind a host iron binding protein. The term "modified" in conjunction with a HIBP surface receptor protein is intended to refer to a non-native HIBP surface receptor protein from which at least one amino acid residue has been removed or in which at least one amino acid residue has been replaced by another, or an HIBP surface receptor protein which has been fragmented in two or more separate polypeptides. Thus modified HIBP surface receptor proteins include, without limitation, truncated HIBP surface receptor proteins (e.g. an N-lobe domain or C-lobe domain of an HIBP surface receptor protein); HIBP surface receptor proteins from which one or more amino acid residues have been removed (e.g. an HIBP surface receptor protein from which one or more amino acids from the loop-domains within the N-lobe domain or C-lobe domain have been removed); HIBP surface receptor proteins in which additional amino acids have been inserted (e.g. HIBP surface receptor proteins in which one or more amino acids have been added to the loop-domains within the N-lobe domain or C-lobe domain); multimeric or extended HIBP polypeptides (e.g. dimers and trimers and N-lobe domain or C-lobe domain dimers and trimers); HIBP surface receptor proteins which have been modified by site-directed mutagenesis to alter one or more amino acids; and mixtures of two or more HIBP surface receptor protein polypeptides (e.g. a mixture comprising a separate N-lobe domains and a C-lobe domains of an HIBP surface receptor protein). The modified HIBP surface receptor proteins of the present disclosure are unable to substantially bind native host iron binding protein.

As hereinbefore mentioned, the present disclosure provides, in one aspect, an immunogenic composition comprising or consisting of a polypeptide comprising a C-lobe domain or an N-lobe domain of an HIBP surface receptor protein obtainable from or obtained from a Gram-negative bacterial species, wherein the polypeptide is unable to substantially bind host iron binding protein. In further aspects, the present disclosure provides a polypeptide comprising a G-lobe domain or an N-lobe domain of an HIBP surface receptor protein wherein the C-lobe domain or the N-lobe domain comprises a plurality of β-strands connected by a plurality of loop domains, and wherein at least one loop domain of the plurality of loop domains has been modified, and wherein the polypeptide is unable to substantially bind host iron binding protein.

In accordance with the present disclosure, any polypeptide or nucleic acid sequence encoding such polypeptide, comprising or consisting of a C-lobe domain or an N-lobe domain of an HIBP surface receptor protein obtainable from a Gram-negative pathogenic bacterial species may be used.

In embodiments of the disclosure where the native C-lobe domain is used, the polypeptide comprising the native C-lobe domain does not comprise and is not chemically linked via a peptide bond to the native N-lobe domain of the HIBP surface receptor protein, and is thus an isolated native C-lobe domain, i.e. a native C-lobe domain separated from the native N-lobe domain. Thus in certain embodiments, preparations comprising a C-lobe domain of an HIBP surface receptor polypeptide free or substantially free of N-lobe domain of an HIBP surface receptor polypeptide, or portions thereof, are provided. In embodiments of the disclosure where the native N-lobe domain is used, the polypeptide comprising the native N-lobe domain used herein does not comprise and is not chemically linked via a peptide bond to the native C-lobe domain of the HIBP surface receptor protein, and is thus an isolated native N-lobe domain, i.e. an N-lobe domain separated from the native C-lobe domain. Thus in certain embodiments, preparations comprising an N-lobe domain of an HIBP surface receptor polypeptide free or substantially free of C-lobe domain of an HIBP surface receptor polypeptide, or portions thereof, are provided. In certain embodiments however, a mixture of a native C-lobe domain, or portions thereof, and the native N-lobe domain, or portions thereof, may be used, provided however, that the N-lobe domain and the C-lobe domain are not chemically linked, i.e. they are not chemically connected by a peptide bond. Thus the present disclosure includes an immunogenic composition comprising a mixture of polypeptides comprising an N-lobe domain and a polypeptide comprising a C-lobe domain, wherein the N-lobe domain and C-lobe domain are not physically linked.

To source the polypeptides of the present disclosure any HIBP surface receptor protein, or TbpB polypeptide obtainable from or obtained from any Gram-negative bacterial species may be used, including, but not limited to, any pathogenic bacterial species or strain, and including, but not limited to, any bacterial species belonging to the bacterial families of Pasteurellaceae, Moxarellaceae or Neisseriaceae, and bacterial species belonging to the bacterial genus *Actinobacillus, Neisseria, Haemophilus, Mannheimia, Histophilus, Pasteurella* or *Moraxella*. The polypeptides further include any polypeptides obtainable from or obtained from any HIBP surface receptor protein, or any polypeptides obtainable from or obtained from any TbpB polypeptide obtainable or obtained from the following bacterial species: *Actinobacillus pleuropneumoniae* (12, 34), *Actinobacillus suis, Haemophilus influenzae* (35, 36), *Haemophilus parasuis* (37), *Haemophilus somnus* (also known to the art as *Histophilus somnus*) (38), *Mannheimia haemolytica* (also known to the art as *Pasteurella haemolytica*) (39), *Moraxella catarrhalis* (40), *Moraxella bovis, Neisseria gonorrhoeae, Neisseria meningitidis* (41, 42), *Mannheimia glucosida* (also known to the art as *Pasteurella haemolytica*) and *Bibersteinia trehalosi* (also known to the art as *Pasteurella trehalosi*).

Exemplary C-lobe domain and N-lobe domain polypeptides that may be used in accordance herewith further include, any C-lobe domain set forth in SEQ.ID NO: 5; SEQ.ID NO: 6; SEQ.ID NO: 22; SEQ.ID NO: 33; SEQ.ID NO: 34; SEQ.ID NO: 119; SEQ.ID NO: 125; SEQ.ID NO: 179 to SEQ.ID NO: 195; SEQ.ID NO: 213 to SEQ.ID NO: 218; SEQ.ID NO: 230; SEQ.ID NO: 232; SEQ.ID NO: 234 to SEQ.ID NO: 278, and SEQ.ID NO: 288 to SEQ.ID NO: 292, and any N-lobe domain set forth in SEQ.ID NO: 8; SEQ.ID NO: 10; SEQ.ID NO: 24; SEQ.ID NO: 26; SEQ.ID NO: 36; SEQ.ID NO: 38; SEQ.ID NO: 121; SEQ.ID NO: 127; SEQ.ID NO: 229; SEQ.ID NO: 231; and SEQ.ID NO: 233, and further include any C-lobe domain or N-lobe domain that may be prepared from a HIBP polypeptide or a TbpB polypeptide including, without limitation the polypeptides set forth in SEQ.ID NO: 2; SEQ.ID NO: 12; SEQ.ID NO: 28; SEQ.ID NO: 107 to SEQ.ID NO: 115; SEQ ID NO: 117; SEQ.ID NO: 123; SEQ.ID NO: 131 to SEQ.ID NO: 147; SEQ.ID NO: 177; SEQ.ID NO: 178; SEQ.ID NO: 196 to SEQ.ID NO: 204; SEQ.ID NO: 206 to SEQ.ID NO: 212; and SEQ.ID NO: 219 to SEQ.ID NO: 228 or by using the nucleic acid sequences encoded by SEQ.ID NO: 1; SEQ.ID NO: 11; SEQ.ID NO: 27; SEQ.ID NO: 116; SEQ.ID NO: 122; and SEQ.ID NO; 173. Using these nucleic acid sequences and polypeptide sequences, additional novel HIBP surface receptor proteins and TbpB sequences, and C-lobe domains or N-lobe domains may readily be identified by those of skill in the art. For example expression libraries, cDNA libraries and genomic libraries may be screened and databases comprising sequence information may be searched for similar sequences.

The immunogenic preparations of the present disclosure elicit, upon administration thereof to a vertebrate subject, an immune response in such vertebrate subject, in the form of the stimulation of antibody production by the vertebrate subject. In accordance herewith, such antibodies are reactive against at least one Gram-negative bacterial strain. Preferably, however, the antibodies are cross-reactive and/or cross-protective against a plurality of bacterial strains or species, and preferably such cross-reactivity and/or cross-protection is attained in a host expressing one or more host iron binding proteins, such as transferrin or lactoferrin. The term "cross-reactive" as used herein refers to the ability of the immune response induced by an immunogenic composition obtained from one bacterial strain to stimulate the production of antibodies capable of additionally reacting with a different bacterial strain or different species. The term "cross-protective" as used herein refers to the ability of the immune response, induced by an immunogenic composition obtained from one bacterial strain, to prevent or attenuate infection or disease by at least one additional bacterial strain or bacterial species. In preferred embodiments of the present disclosure, the immunogenic compositions of the present disclosure are cross-reactive and/or cross-protective against a plurality of bacterial strains or bacterial species, for example, 2, 3, 4, 5, 6, 7, 8, 9 or 10 bacterial species or bacterial strains. Cross-reactivity is deemed to be an indicator of cross-protection. It will be readily appreciated by those of skill in the art that the foregoing aspect of the present disclosure facilitates vaccine manufacture by permitting the production of one immunogenic compound, i.e. an immunogenic compound obtainable from one HIBP surface receptor protein, which offers protection against multiple infectious bacterial strains or bacterial species.

The immunogenic preparations of the present disclosure generate an unexpectedly effective immune response in vertebrate subjects, and notably in vertebrate subjects expressing host iron binding proteins, such as transferrin and lactoferrin, exceeding the effectiveness of the immune response generated when immunizing preparations using native HIBP protein are used. One aspect of the effective immune response is the magnitude of the immune response. Preferably the antibody titre obtained using the immunogenic compositions of the present disclosure exceeds the antibody titre of a native HIBP protein by a factor of at least 2×, more preferably by a factor of at least 5×, most preferably by a factor of at least 10×.

In preferred embodiments, mixtures comprising at least two polypeptides, each polypeptide comprising or consisting of a C-lobe domain are used; or mixtures comprising at least two polypeptides, each polypeptide comprising or consisting of an N-lobe domain, are used; or mixtures comprising at least three polypeptides comprising or consisting of at least two C-lobe domains and at least one N-lobe domain, are used; or mixtures comprising at least three polypeptides comprising or consisting of at least two N-lobe domains and at least one C-lobe domain, are used. In preferred embodiments, the at least two polypeptides are obtainable or obtained from a Gram-negative bacterial genus or species capable of infecting the same vertebrate species. Thus, the at least two polypeptides would be selected from e.g. two C-lobe domains of an TbpB polypeptide, wherein both C-lobe domains are obtainable or obtained from a TbpB polypeptide obtained or obtainable from an *Actinobacillus* strain capable of infecting pigs, or e.g. two C-lobe domains of a TbpB polypeptide, wherein both C-lobe domains are obtainable or obtained from an TbpB polypeptide obtained or obtainable from a *Haemophilus* strain capable of infecting cows. In embodiments wherein at least two C-lobe domains are used, the mixtures are preferably free, or substantially free, of N-lobe domains or portions thereof. In embodiments wherein at least two N-lobe domains are used the mixtures are preferably free or substantially free of C-lobe domains or portions thereof In particularly preferred embodiments, in accordance with the present disclosure, mixtures of at least two polypeptides, each polypeptide comprising or consisting of a C-lobe domain of an HIBP surface receptor protein obtainable or obtained from a Gram-negative bacterial species are used. In such embodiments, the mixtures are preferably free from N-lobe domains or portions thereof. In particularly preferred embodiments, any two C-lobe domains obtainable or obtained from the HIBP surface receptor polypeptides set forth in SEQ.ID NO: 2; SEQ.ID NO: 12; SEQ.ID NO: 28; SEQ.ID NO: 107 to SEQ.ID NO: 115; SEQ ID NO: 117; SEQ.ID NO: 123; SEQ.ID NO: 131 to SEQ.ID NO: 147; SEQ.ID NO: 177; SEQ.ID NO: 178; SEQ.ID NO: 196 to SEQ.ID NO: 204; SEQ.ID NO: 206 to SEQ.ID NO: 212; and SEQ.ID NO: 219 to SEQ.ID NO: 228 are used; or any two C-lobe domains obtainable or obtained from the nucleic acid sequences set forth in SEQ.ID NO: 1; SEQ.ID NO: 11; SEQ.ID NO: 27; SEQ.ID NO: 116; SEQ.ID NO: 122; and SEQ.ID NO: 173 are used. In further preferred embodiments, any two C-lobe domains selected from the C-lobe domains set forth in SEQ.ID NO: 5; SEQ.ID NO: 6; SEQ.ID NO: 22; SEQ.ID NO: 33; SEQ.ID NO: 34; SEQ.ID NO: 119; SEQ.ID NO: 125; SEQ.ID NO: 179 to SEQ.ID NO: 195; and SEQ.ID NO: 213 to SEQ.ID NO: 218; SEQ.ID NO: 230: SEQ.ID NO: 232; SEQ.ID NO: 234 to SEQ.ID NO: 278; and SEQ.ID NO: 288 to SEQ.ID NO: 292 are used.

In further particularly preferred embodiments, at least two C-lobe domains obtainable or obtained from an HIBP surface receptor protein are used, wherein at least one C-lobe domain is obtainable or obtained from a bacterial species belonging to the bacterial genus of Actinobacillus, Haemophilus, Histophilus, Mannheimia, Moraxella, Neisseria, Pasteurella and Bibersteinia.

In further particularly preferred embodiments, at least two C-lobe domains are used, wherein at least one C-lobe domain is obtainable or obtained from an HIBP surface receptor protein obtainable or obtained from Actinobacillus pleuropneumoniae, preferably the C-lobe domain set forth in SEQ.ID. NO: 6 or SEQ.ID NO: 22, or wherein at least one C-lobe domain is obtainable or obtained from an HIBP surface receptor protein obtainable or obtained from Actinobacillus suis preferably the C-lobe domain set forth in SEQ.ID NO: 34.

In further particularly preferred embodiments, at least two C-lobe domains are used, wherein at least one C-lobe domain is obtainable or obtained from an HIBP surface receptor protein obtainable or obtained from Mannheimia haemolytica preferably the C-lobe domain set forth in SEQ.ID NO: 232; or SEQ.ID NO: 234, or wherein at least one C-lobe domain is obtainable or obtained from an HIBP surface receptor protein obtainable or obtained from Mannheimia glucosida.

In further particularly preferred embodiments, at least two C-lobe domains are used, wherein at least one C-lobe domain is obtainable or obtained from an HIBP surface receptor protein obtainable or obtained from Neisseria gonorrhoeae preferably one of the C-lobe domains set forth in SEQ.ID NO: 213 to SEQ.ID NO: 218, or wherein at least one C-lobe domain is obtainable or obtained from an HIBP surface receptor protein obtainable or obtained from Neisseria meningitidis preferably one of the C-lobe domains set forth in SEQ.ID. NO: 119; SEQ.ID NO: 125; SEQ.ID NO: 128; SEQ.ID NO: 129; SEQ.ID NO: 130; SEQ.ID NO: 131; SEQ.ID NO: 152; SEQ.ID NO: 154; SEQ.ID NO: 156; SEQ.ID NO: 158; SEQ.ID NO: 160; SEQ.ID NO: 164; SEQ.ID NO: 166; SEQ.ID NO: 168; SEQ.ID NO: 179 to SEQ.ID NO: 195; and SEQ.ID NO: 235 to SEQ.ID NO: 278.

In further particularly preferred embodiments, at least two C-lobe domains are used, wherein at least one C-lobe domain is obtainable or obtained from an HIBP surface receptor protein obtainable or obtained from Bibersteinia trehalosi, preferably the C-lobe domain set forth in SEQ. ID.NO: 292.

In further preferred embodiments, at least two C-lobe domains obtainable or obtained from a HIBP surface receptor polypeptide are used, wherein both of the two C-lobe domains are obtainable or obtained from two bacterial species selected from Actinobacillus pleuropneumoniae, preferably, the C-lobe domain set forth in SEQ.ID NO: 6 or SEQ.ID NO: 22, Actinobacillus suis, preferably the C-lobe domain set forth in SEQ.ID NO: 34 and Haemophilus parasuis, preferably the C-lobe domain set forth in SEQ.ID NO: 294.

In further preferred embodiments, at least two C-lobe domains obtainable or obtained from a HIPB surface receptor polypeptide are used, wherein one of the two C-lobe domains are obtainable or obtained from Neisseria gonorrhoeae, preferably, one of the C-lobe domains set forth in SEQ.ID. NO: 213 to SEQ.ID. NO: 218 and the other C-lobe domain is obtainable from Neisseria meningitidis preferably one of the C-lobe domains set forth in SEQ.ID. NO: 119; SEQ.ID NO: 125; SEQ.ID NO: 128; SEQ.ID NO: 129; SEQ.ID NO: 130; SEQ.ID NO: 131; SEQ.ID NO: 152; SEQ.ID NO: 154; SEQ.ID NO: 156; SEQ.ID NO: 158; SEQ.ID NO: 160; SEQ.ID NO: 164; SEQ.ID NO: 166; SEQ.ID NO: 168; SEQ.ID NO: 179 to SEQ.ID NO: 195; and SEQ.ID NO: 235 to SEQ.ID NO: 278.

In further preferred embodiments, at least two C-lobe domains obtainable or obtained from a HIPB surface receptor polypeptide are used, wherein one of the two C-lobe domains is obtainable or obtained from Mannheimia haemolytica, preferably a C-lobe domain set forth in SEQ.ID NO: 232; or SEQ.ID NO: 234, and the other C-lobe is obtainable or obtained from Bibersteinia trehalosi preferably a C-lobe domain set forth in SEQ.ID NO: 292.

In further preferred embodiments, at least two C-lobe domains obtainable or obtained from a TbpB polypeptide are used, wherein both of the two C-lobe domains are obtainable or obtained from one or from two bacterial species, and wherein the TbpB polypeptides or the C-lobe domains obtained therefrom are antigenically divergent. The TbpB or C-lobe domains are preferably obtained from bacterial species or bacterial strains capable of exchanging TbpB variants. The term "antigenically divergent" as used herein in relation to two TbpB polypeptides or C-lobe domains of TbpB polypeptides means that the two TbpB polypeptides or C-lobe domains of TbpB polypeptides when used to construct a phylogenetic tree using a representative number of TbpB polypeptides or C-lobe domain polypeptides belong to divergent branches or groups of a phylogenetic tree. In accordance herewith, a phylogenetic tree with any amount of TbpB or C-lobe domain polypeptides may be constructed, however preferably a phylogenetic tree is constructed using at least 25 TbpB polypeptides or C-lobe domain polypeptides, more preferably at least 30, at least 40, or at least 50 TbpB polypeptides or C-lobe domain polypeptides, and preferably a phylogenetic tree is constructed in such a manner that it comprises at least 2 node orders above the root level, more preferably a phylogenetic tree comprises at least 3, 4, or 5 node orders above the root level, most preferably, at least 6, 7, 8, 9, or 10 node orders above the root level (as further explained below and in FIG. 30). Antigenically divergent TbpB polypeptides or C-lobe domain polypeptides preferably belong to distinct branches which (i) diverge at a node at least 2 node orders below the highest order node of the phylogenetic tree (e.g. if the highest order node of a phylogenetic tree is the $9^{th}$ order node, antigenically divergent polypeptides are those polypeptides diverging at the $7^{th}$ order node, or a lower order node, i.e. the $6^{th}$, $5^{th}$, $4^{th}$, $3^{rd}$, $2^{nd}$, or $1^{st}$ order node; and/or (ii) diverge at a $1^{st}$, $2^{nd}$ or $3^{rd}$ node order of a phylogenetic tree. Several computer programs may be used to facilitate construction of phylogenetic trees using TbpB polypeptides or C-lobe domain polypeptides including: (i) computer programs performing sequence alignments, such as a program using the M-Coffee alignment algorithm as implemented on the T-Coffee server site (www.tcoffee.org/) (43); (ii) computer programs editing alignments, such as Geneious Pro (44); (iii) computer programs automatically cleaning alignments, such as GBlocks (45); (iv) computer programs selecting an evolutionary model compatible with the alignment, such as ProtTest v3.2 (Darriba et al, 2011) and (iv) computer programs generating phylogenetic trees such as programs using the Maximum likelihood method, PhyML (46), running on the general time reversible (GTR) model (47) (48, 49), or other model such as the JTT+I+G+F model, or the WAG+G=F model, or programs such as PHYLIP and PAUP (University of Washington). Each of these programs is preferably configured so that the tree branches are deemed to be statistically significant. It is noted however that the more distally located branches may be less statistically significant, thus selection of strains belonging to groups based from the lowest order nodes is preferred.

Now referring to FIG. 30, there is shown, for illustrative purposes, a phylogenetic tree 100 having a root 120, intermediate branches (as illustrated by 130, 131, 140, 141, 142 and 143), and a total of 38 distal branches (as illustrated by distal branches 150, 151, 152, 153, 154 and 155), each distal branch representing a related polypeptide obtained from 1 of 38 bacterial strains (strain 1-38 (110)). Each branch shown originates from a node (as illustrated by nodes 161, 171, 172, 181, 182, 183 and 184). Thus, for example, branch 130 originates from node 161 and branch 143 originates from node 172. The node (161) most proximal to the tree root (120) is more specifically referred to as the first order node 161; nodes 171 and 172 are more specifically referred to as $2^{nd}$ order nodes 171 and 172; nodes 181, 182, 183 and 184 are more specifically referred to as $3^{rd}$ order nodes 181, 182, 183 and 184, and further nodes, mutatis mutandis, may be referred to as $4^{th}$, $5^{th}$, $6^{th}$, $7^{th}$ etc. order nodes. Shown in FIG. 30 are further four Groups (Group 1 (105), polypeptides of bacterial strains (110) 1-17; Group 2 (106), polypeptides of bacterial strains (110) 18-24; Group 3 (107), polypeptides of bacterial strains (110) 25-30; and Group 4 (108), polypeptides of bacterial strains (110) 26-38). Polypeptides of bacterial strains belonging to either Group 1 (105) or Group 2 (106) both belong to a branch (131) diverging at the first order node (161) of the phylogenetic tree (100). Similarly, polypeptides of bacterial strains belonging to either Group 3 (105) or Group 4 (106) both belong to a branch (131) diverging at the first order node (161) of the phylogenetic tree (100). Thus polypeptides of all bacterial strains belonging to Group 1 (105) or Group 2 (106) are antigenically divergent from polypeptides of all bacterial strains belonging to Group 3 (107) or Group 4 (108). Polypeptides of bacterial strains belonging to Group 1 (105) or Group 2 (106) belong to groups diverging at the $2^{nd}$ order node (172) of the phylogenetic tree (100). Polypeptides of bacterial strains belonging to Group 1 (105) are in accordance herewith also antigenically divergent from bacterial strains belonging to Group 2 (106). It is noted that phylogenetic trees may be represented in different formats, for example, in a rectangular format, as in FIG. 30, for example, or in circular format as in FIG. 10. Exemplary phylogenetic trees constructed using TbpB polypeptides or C-lobes or TbpB polypeptides are provided in FIG. 4 (comprising strains of *Actinobacillus pleuropneumoniae, Actinobacillus suis* and *Haemophilus parasuis*), FIG. 10 (comprising strains of *Neisseria meningitidis*), FIG. 26 (comprising strains of *Neisseria meningitidis* and *Neisseria gonorrhoeae*), FIG. 27 (comprising strains of *Haemophilus influenza*), FIG. 28 (comprising strains of *Mannheimia haemolytica* and *Bibersteinia trehalosi*) and FIG. 29 (comprising strains of *Moraxella catharrhalis*).

In further preferred embodiments, at least two C-lobe domains obtainable or obtained from a TbpB polypeptide are used, wherein both of the two C-lobe domains are obtainable or obtained from *Actinobacillus pleuropneumoniae, Actinobacillus suis* and *Haemophilus parasuis*. Referring to the phylogenetic tree set forth in FIG. 4, in preferred embodiments, at least two C-lobe domains are used, wherein a first C-lobe domain is obtained from any one of the C-lobe domains selected from a *Actinobacillus pleuropneumoniae, Actinobacillus suis* or *Haemophilus parasuis* bacterial strain belonging to phylogenetic Group 1, phylogenetic Group 2 or phylogenetic Group 3, set forth in FIG. 4, and wherein the second C-lobe domain is obtained from any one of the C-lobe domains selected from a *Actinobacillus pleuropneumoniae, Actinobacillus suis* or *Haemophilus parasuis* strain belonging to a phylogenetic Group set forth in FIG. 4, other than the phylogenetic Group the first C-lobe domain is selected from. In further preferred embodiments, at least three C-lobe domains are used, wherein a first C-lobe domain belonging to a *Actinobacillus pleuropneumoniae, Actinobacillus suis* or *Haemophilus parasuis* bacterial strain belonging to phylogenetic Group 1 set forth in FIG. 4 is used, a second C-lobe domain belonging to *Actinobacillus pleuropneumoniae, Actinobacillus suis* or *Haemophilus parasuis* bacterial strain belonging to phylogenetic Group 2 set forth in FIG. 4 is used, and a third C-lobe domain belonging to a *Actinobacillus pleuropneumoniae, Actinobacillus suis* or *Haemophilus parasuis* bacterial strain belonging to phylogenetic Group 3 set forth in FIG. 4 is used. Thus by way of specific example, a C-lobe domain from *Actinobacillus suis* H57 (phylogenetic Group 1; FIG. 4 black arrow)) may be combined with a C-lobe domain from *Actinobacillus pleuropneumoniae* H87 (phylogenetic Group 2; FIG. 4 black arrow) and a C-lobe domain from *Actinobacillus pleuropneumoniae* H49 (phylogenetic Group 3; FIG. 4 black arrow).

Figure 10A:
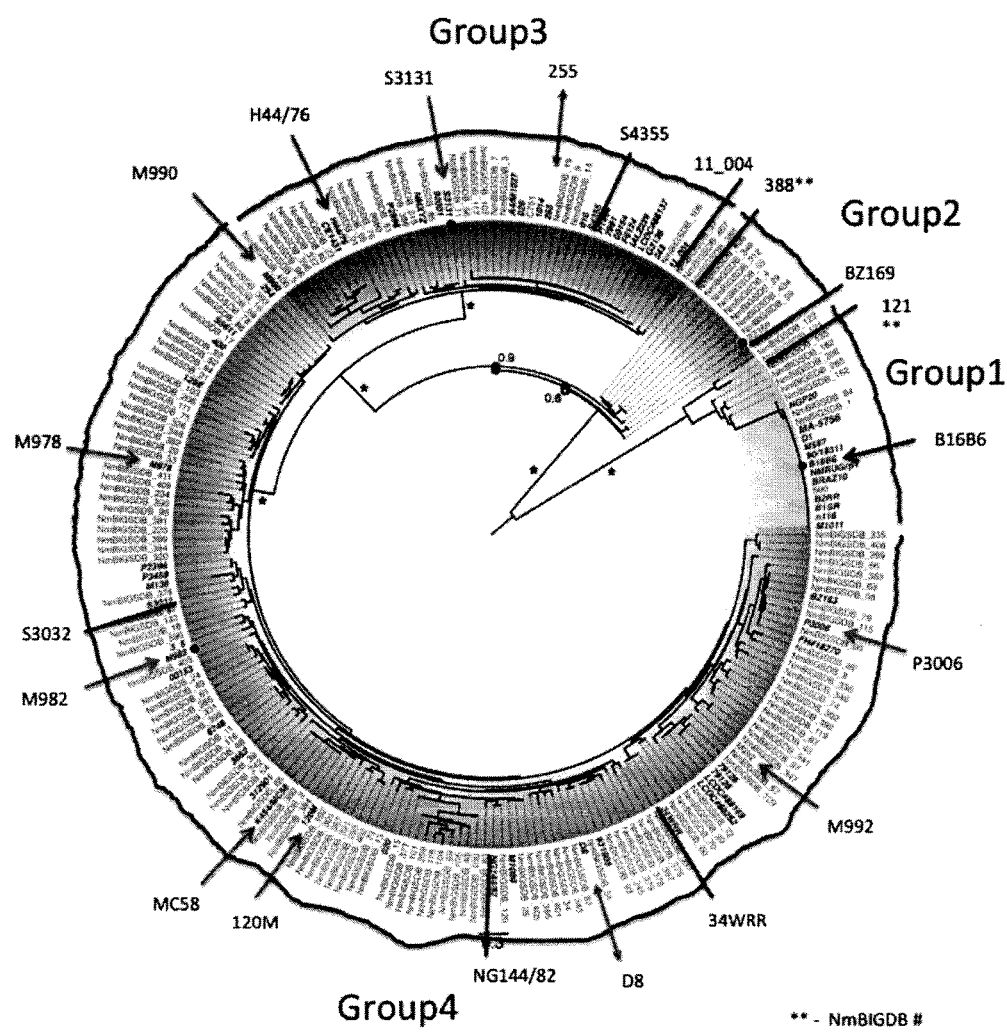
FIG. 10A illustrates the sequence diversity of the intact TbpBs. The sequences for TbpBs from strains indicated by arrows, double arrows, or lines are appended (SEQ.ID NO: 117; SEQ.ID NO: 124; SEQ.ID NO: 132 to SEQ.ID NO: 147; SEQ.ID NO: 177; and SEQ.ID NO: 178) to provide representative sequences for the identified groups. Two primary clades represented by Group 1 and by Groups 2-4 are identified within this tree corresponding to isotype I and isotype II TbpB lineages (22). Support values for primary branches are depicted, and a "*" identifies branches with 100% support. Antigens derived from the TbpB from strain B16B6 (SEQ.ID NO: 117, black arrow) were used to generate the antisera analyzed in FIG. 11 and were screened for reactivity against TbpBs from the strains illustrated by the grey arrows (SEQ.ID NOs: 123; and SEQ.ID NO: 132 to SEQ.ID NO: 139) using our custom ELISA assay (FIG. 5).
Figure 13:
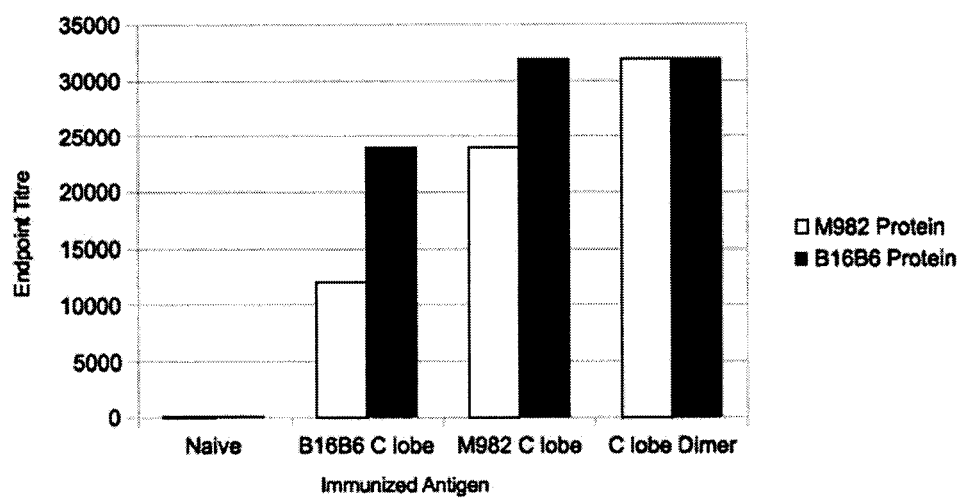
FIG. 13 depicts the analysis of the immune response against a dimer comprised of the TbpB C-lobe from two different strains of the human pathogen *Neisseria meningitidis* (SEQ ID NO: 150). The pairs of bars represent sera obtained from rabbits immunized with adjuvant alone (naive), with B16B6 C-lobe (SEQ.ID NO: 119), with M982 C-lobe (SEQ.ID NO: 125) or the dimer of B16B6 and M982 C-lobes (SEQ.ID NO: 150) illustrated in FIG. 12. The white bars represent results of the novel, custom ELISA assay with immobilized intact M982 TbpB (SEQ.ID NO: 123) and the black bar represents the results with immobilized intact B16B6 protein (SEQ.ID NO: 117).
Figure 15:
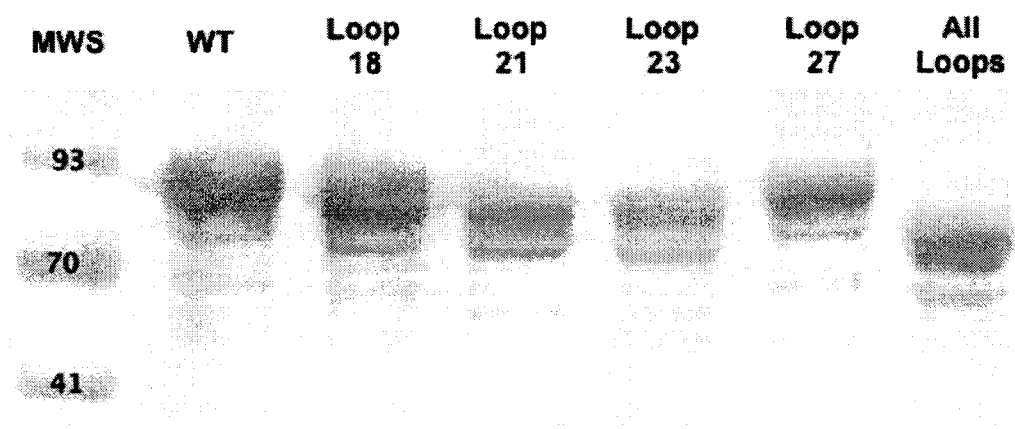
FIG. 15 depicts the microbial production of the modified C-lobes of *N. meningitidis* M982 described in FIG. 14. The wild-type (WT) C-lobe (SEQ.ID NO: 125) corresponds to the model on the left hand side in Panel A of FIG. 14. The other samples represent proteins with truncations in the loops L18, L21, L23, and L27 and the protein with all four loops removed (all loops). The structural model for this protein (SEQ.ID NO: 129) is illustrated in the middle of Panel A in FIG. 14. Protein molecular weight standards (MWS) observed on this gel are 93, 70 and 41 kDa.
Figure 16:
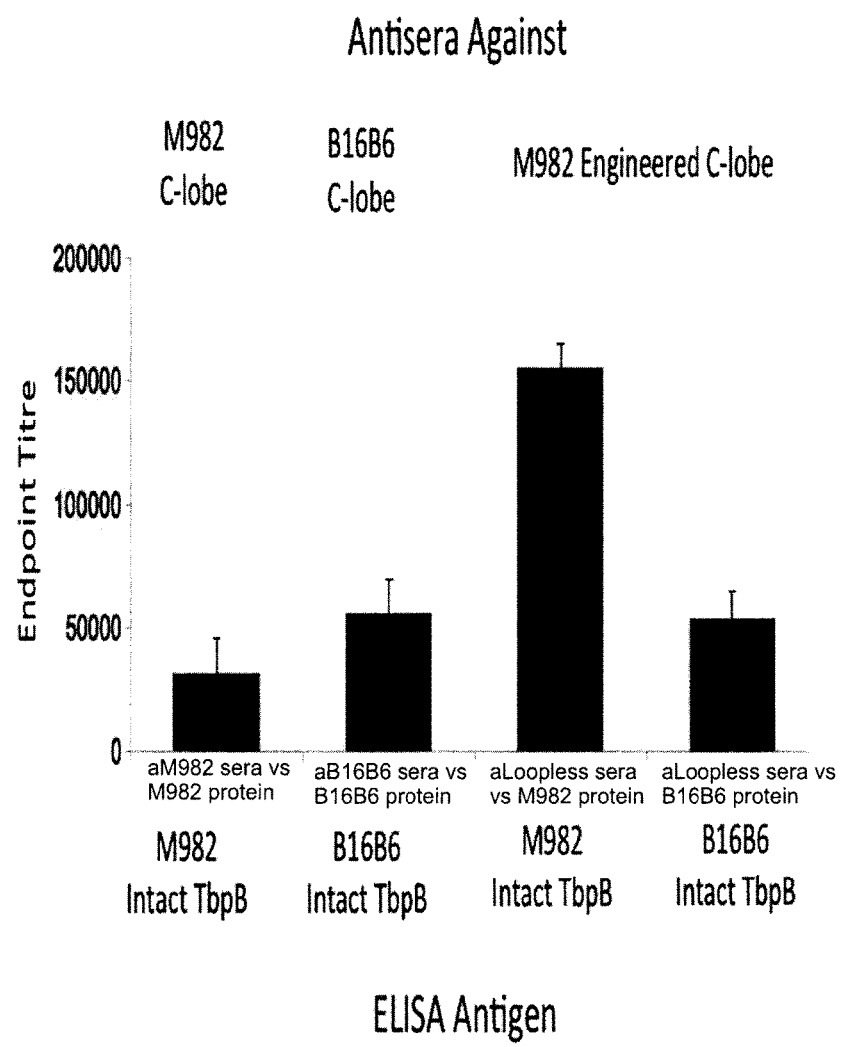
FIG. 16 depicts the immunogenicity of the modified C-lobe of *N. meningitidis* strain M982 relative to the native C-lobes from strain M982 and B16B6. The endpoint titres of mouse antisera were determined with our custom ELISA assay. Mice were either immunized with the C-lobe from strain M982 (SEQ.ID NO: 125, first bar), the C-lobe TbpB from strain B16B6 (SEQ.ID NO: 119, second bar) or the 'loopless' M982 C-lobe (SEQ.ID NO: 129, last two bars). The sera were tested against immobilized intact TbpB from strain M982 (SEQ.ID NO: 123) (first and third bars) or strain B16B6 (SEQ.ID NO: 117) (second and fourth bars). The results show that the modified C-lobe was more immunogenic as it resulted in a higher titre against intact TbpB from strain M982 than the parent C-lobe protein (compare bars 3 and 1). Surprisingly the modified C-lobe even produced a similar level of reactivity to the heterologous B16B6 TbpB as the C-lobe from that strain (compare bars 4 and 2).
Figure 30:
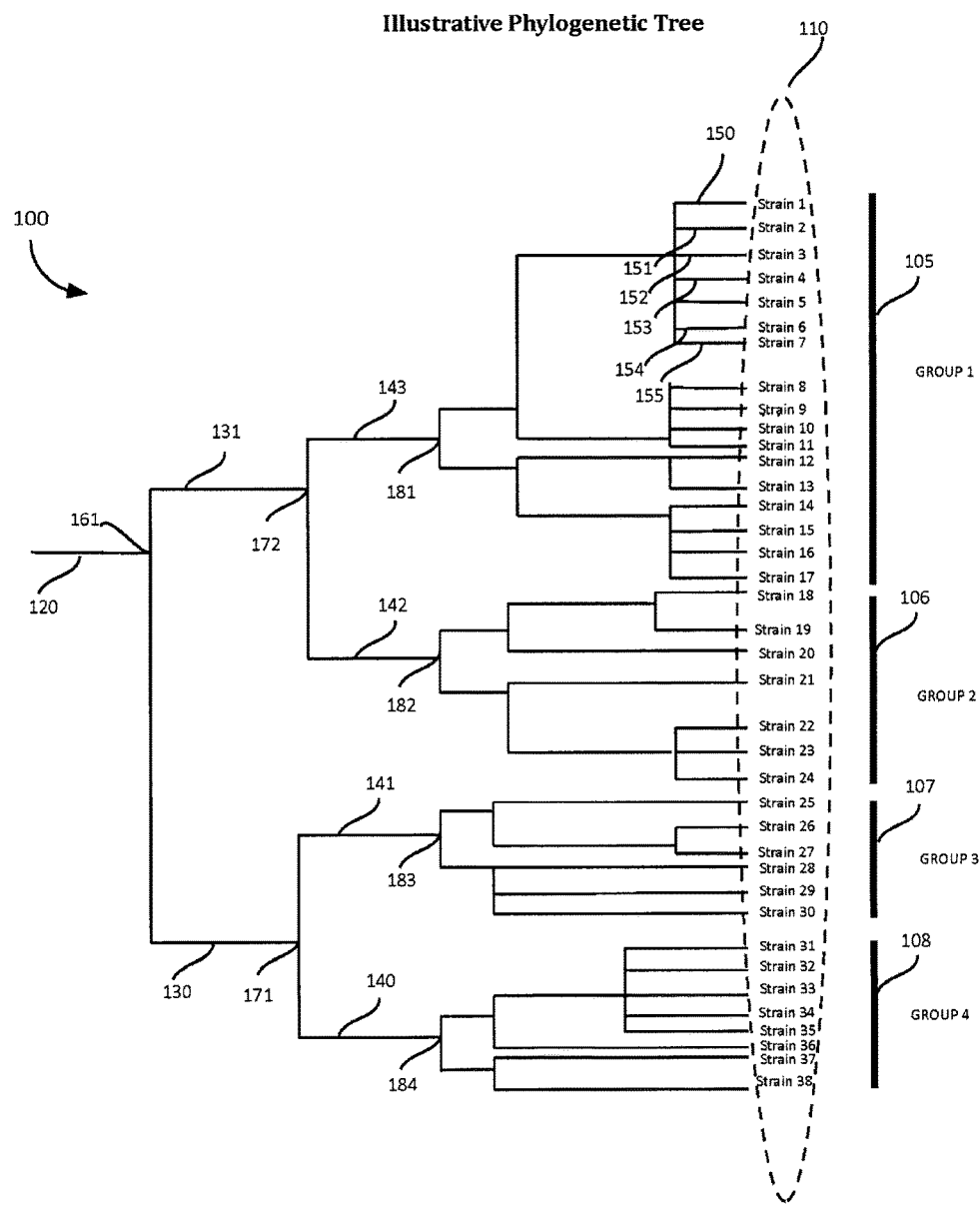

In further preferred embodiments, at least two C-lobe domains obtainable or obtained from a TbpB protein are used, wherein both of the two C-lobe domains are obtainable or obtained from *Neisseria meningitidis*, Referring to the phylogenetic tree set forth in FIG. HA, in preferred embodiments, at least two C-lobe domains are used, wherein a first C-lobe domain is obtained from any one of the C-lobe domains selected from a *Neisseria meningitidis* bacterial strain belonging to phylogenetic Group 1, phylogenetic Group 2, phylogenetic Group 3 or phylogenetic Group 4 set forth in FIG. 10A, and wherein the second C-lobe domain is obtained from any one of the *Neisseria meningitidis* strains belonging to a phylogenetic Group set forth in FIG. 10A other than the phylogenetic Group the first C-lobe domain is selected from. Thus by way of example only, a TbpB C-lobe domain obtained from *Neisseria meningitidis* strain B16B6 (phylogenetic Group 1; FIG. 10A, black arrow) may be combined with a TbpB C-lobe domain from strain M982 (phylogenetic Group 4; FIG. 10A, black arrow). In further preferred embodiments, at least three C-lobe domains are used wherein the C-lobe domains are selected from strains belonging to three different Groups set forth in FIG. 10A (e.g. a C-lobe domain selected from each phylogenetic Group 1, phylogenetic Group 2 and phylogenetic Group 3). In further preferred embodiments, at least four C-lobe domains are used, wherein a first C-lobe domain belonging to a *Neisseria meningitidis* bacterial strain belonging to Group 1 set forth in FIG. 10A is used, a second C-lobe domain belonging to *Neisseria meningitidis* bacterial strain belonging to Group 2 set forth in FIG. 10A is used, and a third C-lobe domain belonging to a *Neisseria meningitidis* bacterial strain belonging to phylogenetic Group 3 set forth in FIG. 10A is used and a fourth C-lobe domain belonging to a *Neisseria meningitidis* bacterial strain belonging to phylogenetic Group 4 set forth in FIG. 10A is used. Thus by way of specific example only, a TbpB C-lobe domain from a *Neisseria meningitidis* strains B16B6 (phylogenetic Group 1; FIG. 10A, black arrow), BZ169 (phylogenetic Group 2; FIG. 10A, black arrow), 53131 (phylogenetic Group 3; FIG. 10A, black arrow) and M982 (phylogenetic Group 4; FIG. 10A, black arrow) may be selected.

In further preferred embodiments, at least two C-lobe domains obtainable or obtained from a TbpB polypeptide are used, wherein one of the two C-lobe domains is obtainable or obtained from *Neisseria meningitidis* and the other of the C-lobes is obtainable or obtained from *Neisseria gonorrhoeae*. Referring to the phylogenetic tree set forth in FIG. 26B, in preferred embodiments, at least two C-lobe domains are used, wherein a first C-lobe domain is obtained from any one of the C-lobe domains selected from a *Neisseria gonorrhoeae* bacterial strain belonging to phylogenetic Group 3, set forth in FIG. 26B, and wherein the second C-lobe domain is obtained from any one of the C-lobe domains selected from a *Neisseria meningitidis* strain belonging to phylogenetic Group 1 or Group 2, set forth in FIG. 26B. More preferably, at least three C-lobe domains obtainable or obtained from a TbpB polypeptide are used, wherein two C-lobe domains are obtainable or obtained from *Neisseria meningitidis* and the other C-lobes is obtainable or obtained from *Neisseria gonorrhoeae*. Preferably a C-lobe domain is selected from a *Neisseria gonorrhoeae* bacterial strain belonging to phylogenetic Group 3, set forth in FIG. 26B, a the second C-lobe domain is obtained from any one of the C-lobe domains selected from a *Neisseria meningitidis* strain belonging to a phylogenetic Group 2, set forth in FIG. 26B, and the third C-lobe domain is obtained from any one of the C-lobe domains selected from a *Neisseria meningitidis* strain belonging to a phylogenetic Group 1, set forth in FIG. 26B. In further preferred embodiments, at least four C-lobe domains obtainable or obtained from a TbpB polypeptide are used, wherein three C-lobe domains are obtainable or obtained from *Neisseria meningitidis* and the other C-lobe domain is obtainable or obtained from *Neisseria gonorrhoeae*. Preferably a C-lobe domain is selected from a *Neisseria gonorrhoeae* bacterial strain belonging to phylogenetic Group 3, set forth in FIG. 26B, the second, and third, C-lobe domain are obtained from any of the C-lobe domains selected from a *Neisseria meningitidis* strain belonging to two different Subgroups of phylogenetic Group 2 (e.g. phylogenetic Subgroup 2.1 and phylogenetic Subgroup 2.2) set forth in FIG. 26B, and the fourth C-lobe domain is obtained from any one of the C-lobe domains selected from a *Neisseria meningitidis* strain belonging to a phylogenetic Group 1, set forth in FIG. 26B. In further preferred embodiments, at least four C-lobe domains obtainable or obtained from a TbpB polypeptide are used, wherein two C-lobe domains are obtainable or obtained from *Neisseria meningitidis* and the other two C-lobes is obtainable or obtained from *Neisseria gonorrhoeae*. Preferably the two C-lobe domains selected from a *Neisseria gonorrhoeae* bacterial strain belong to two different phylogenetic Subgroups of phylogenetic Group 3 (e.g. Subgroup 3.1 and Subgroup 3.2), set forth in FIG. 26B, the third and fourth C-lobe domains are obtained from a *Neisseria meningitidis* strain belonging to phylogenetic Group 1 and phylogenetic Group 2, respectively. In a further embodiment, at least five C-lobe domains obtainable or obtained from a TbpB polypeptide are used, wherein three C-lobe domains are obtainable or obtained from *Neisseria meningitidis* and the other two C-lobes is obtainable or obtained from *Neisseria gonorrhoeae*. Preferably the two C-lobe domains selected from a *Neisseria gonorrhoeae* bacterial strain belong to two different phylogenetic Subgroups of phylogenetic Group 3 (e.g. Subgroup 3.1 and Subgroup 3.2), set forth in FIG. 26B, the third and fourth C-lobe domains are obtained from a *Neisseria meningitidis* strain belonging to two different phylogenetic Subgroups of phylogenetic Group 2 (e.g. Subgroup 2.1 and Subgroup 2.2), set forth in FIG. 26B, and the fifth C-lobe domain belongs to a *Neisseria meningitidis* strain belonging to phylogenetic Group 1 set forth in FIG. 26B. In a yet further preferred embodiment, at least six C-lobe domains obtainable or obtained from a TbpB polypeptide are used. In this embodiment at least one C-lobe domain is obtained or obtainable from *Neisseria meningitidis* and at least one C-lobe domain is obtained or obtainable from *Neisseria gonorrhoeae*, the other C-lobes are obtained or obtainable from strains that are antigenically divergent in accordance with FIG. 26B. In preferred embodiments, three C-lobe domains are obtainable or obtained from *Neisseria meningitidis* and the other three C-lobes are obtainable or obtained from *Neisseria gonorrhoeae*. Referring to FIG. 26B preferably the three C-lobe domains obtained from the *Neisseria gonorrhoeae* strains belong to three antigenically divergent groups, and the three C-lobe domains obtained from *Neisseria meningitidis* belong to three antigenically divergent strains.

In further preferred embodiments, at least two C-lobe domains obtainable or obtained from a TbpB polypeptide are used, wherein one of the two C-lobe domains is obtainable or obtained from *Neisseria meningitidis* and the other of the C-lobes is obtainable or obtained from *Neisseria gonorrhoeae*. Referring to the phylogenetic tree set forth in FIG. 26A, in preferred embodiments, at least two C-lobe domains are used, wherein a first C-lobe domain is obtained from any one of the C-lobe domains selected from a *Neisseria gonorrhoeae* bacterial strain belonging to phylogenetic Group 3 or phylogenetic Group 1, set forth in FIG. 26A, and wherein the second C-lobe domain is obtained from any one of the C-lobe domains selected from a *Neisseria meningitidis* strain belonging to a phylogenetic Group 2, Group 4 or Group 5, set forth in FIG. 26A.

In further preferred embodiments, at least two C-lobe domains obtainable or obtained from a TbpB protein are used, wherein both of the two C-lobe domains are obtainable or obtained from *Haemophilus influenzae*. Referring to the phylogenetic tree set forth in FIG. 27A and FIG. 27B, in preferred embodiments, at least two C-lobe domains are used, wherein a first C-lobe domain is obtained from any one of the C-lobe domains selected from a *Haemophilus influenzae* bacterial strain belonging to phylogenetic Group 1, phylogenetic Group 2, or phylogenetic Group 3 set forth in FIG. 27A or FIG. 27B, and wherein the second C-lobe domain is obtained from any one of the *Haemophilus influenzae* strains belonging to a phylogenetic Group set forth in FIG. 27A or FIG. 27B other than the phylogenetic Group the first C-lobe domain is selected from. Thus by way of example only, a TbpB C-lobe domain obtained from *Haemophilus influenzae* strain H216 (phylogenetic Group 3; FIG. 27B, black arrow) may be combined with a TbpB C-lobe domain from strain H214 (phylogenetic Group 1; FIG. 27B, black arrow). In further preferred embodiments, at least three C-lobe domains are used wherein the C-lobe domains are selected from strains belonging to three different Groups set forth in FIG. 27A and FIG. 27B (i.e. a C-lobe domain selected from each phylogenetic Group 1, phylogenetic Group 2 and phylogenetic Group 3). Thus by way of specific example only, a TbpB C-lobe domain from a *Haemophilus influenzae* strains H216 (phylogenetic Group 3; FIG. 27B, black arrow), H214 (phylogenetic Group 1;

Figure 27A:
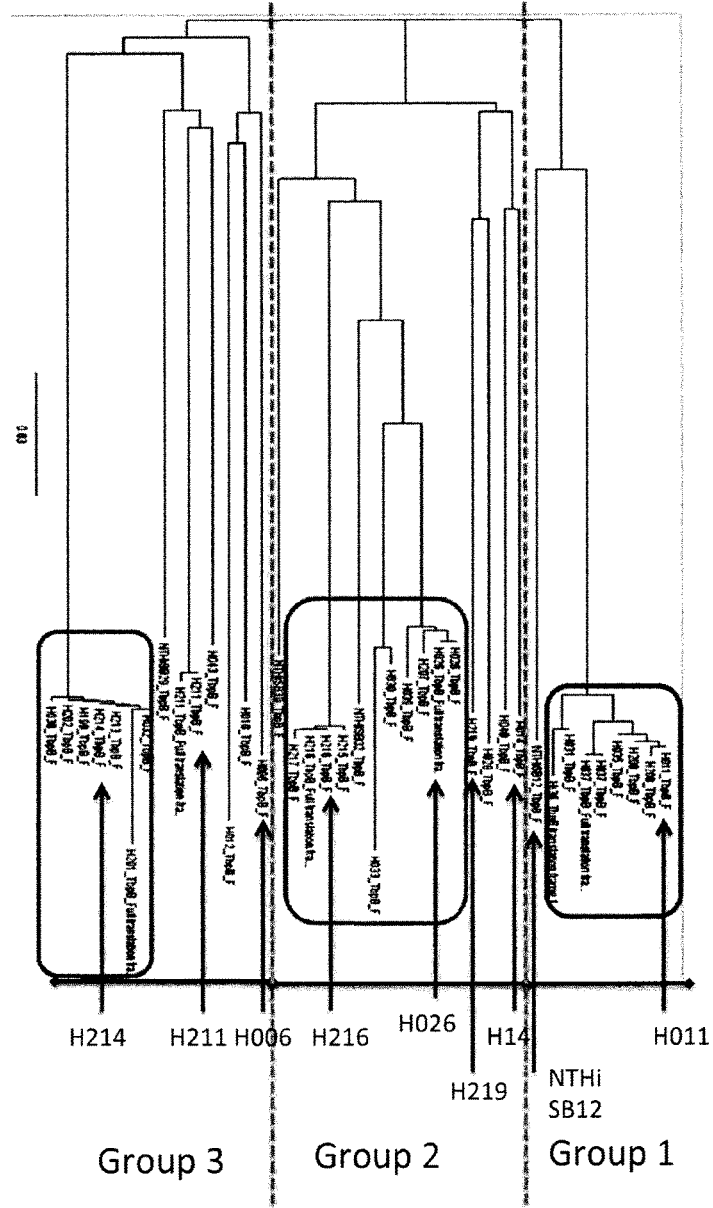
Figure 27B:
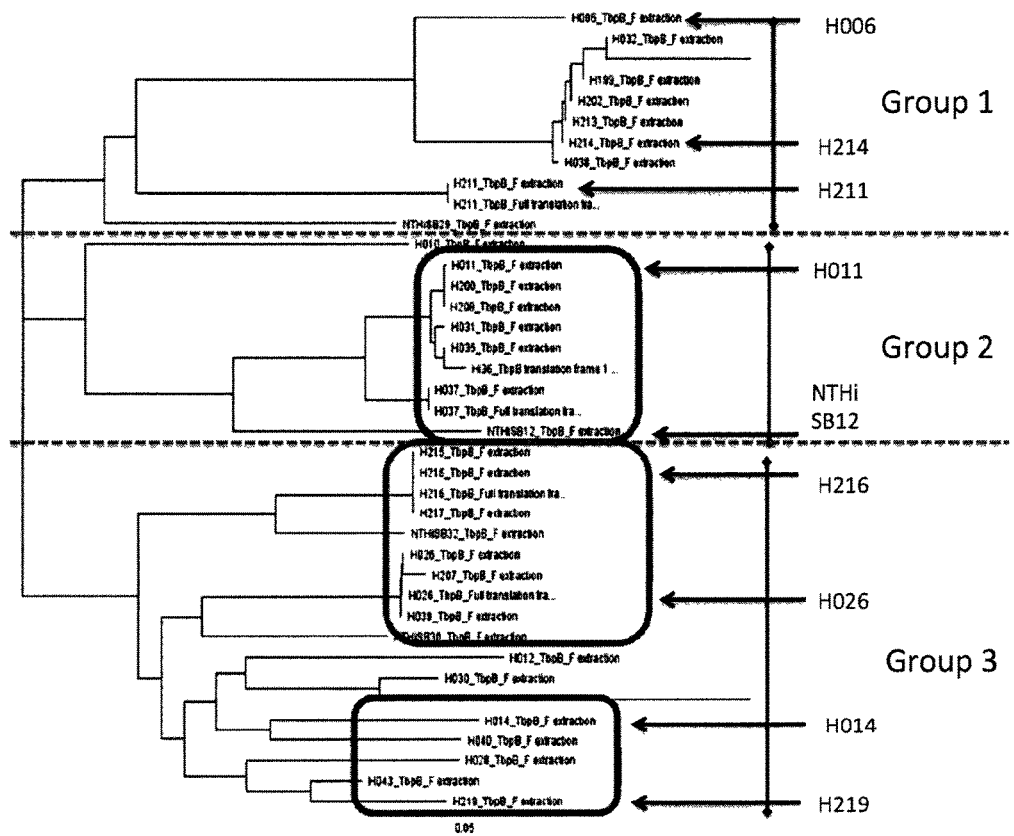

FIG. 27B, black arrow), and H011 (phylogenetic Group 2; FIG. 27B, black arrow) may be selected.

In further preferred embodiments, at least two C-lobe domains obtainable or obtained from a TbpB protein are used, wherein both of the two C-lobe domains are obtainable or obtained from *Mannheimia haemolytica*. Referring to the phylogenetic tree set forth in FIG. 28, in preferred embodiments, at least two C-lobe domains are used, wherein a first C-lobe domain is obtained from any one of the C-lobe domains selected from a *Mannheimia haemolytica* bacterial strain belonging to phylogenetic Group 1, set forth in FIG. 28, and wherein the second C-lobe domain is obtained from any one of the *Mannheimia haemolytica* strains belonging to a phylogenetic Group 3.

Figure 28:
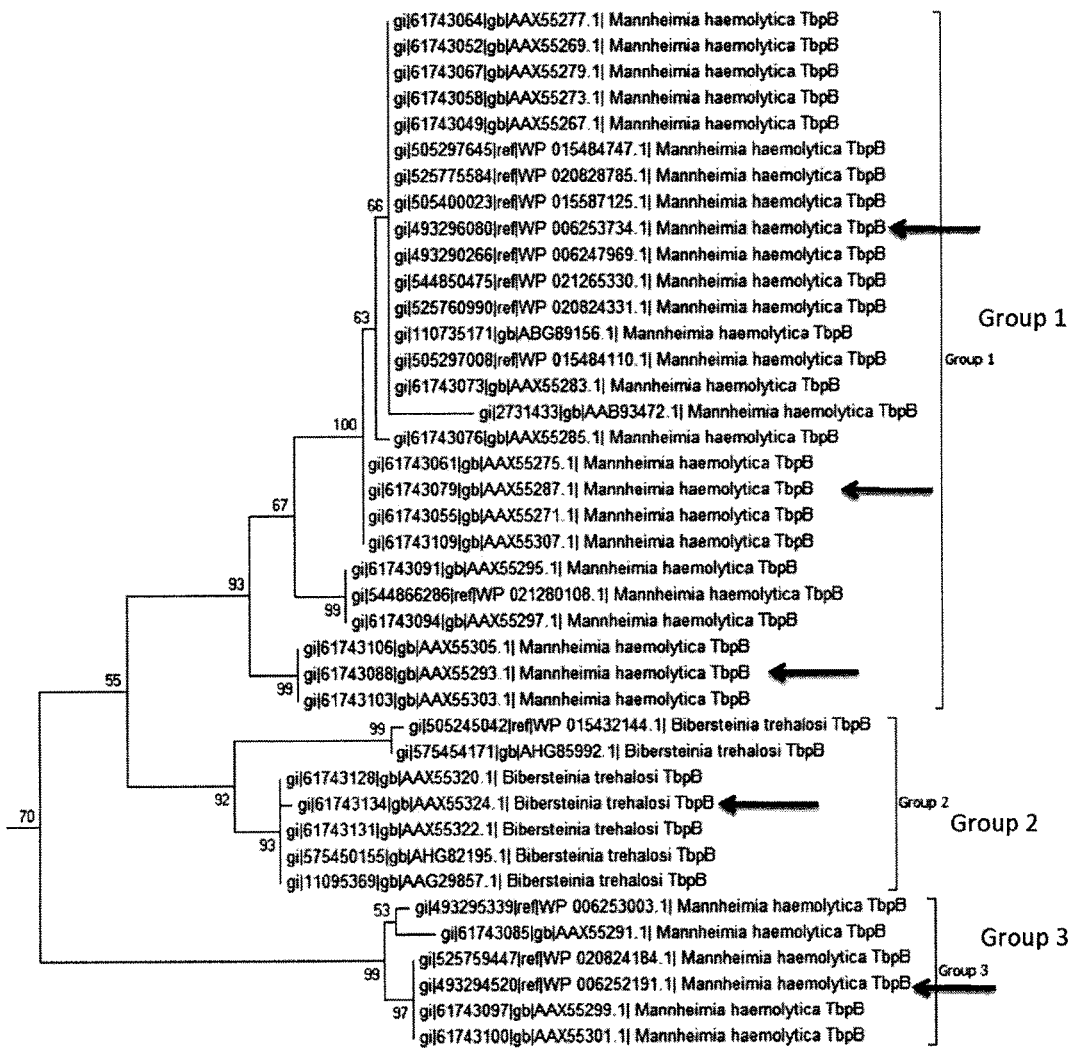

In further preferred embodiments, at least two C-lobe domains obtainable or obtained from a TbpB polypeptide are used, wherein one of the two C-lobe domains is obtainable or obtained from *Bibersteinia trehalosi* and the other of the C-lobes is obtainable or obtained from *Mannheimia haemolytica*. Referring to FIG. 28, in preferred embodiments, at least two C-lobe domains are used, wherein a first C-lobe domain is obtained from any one of the C-lobe domains selected from a *Bibersteinia trehalosi* bacterial strain belonging to phylogenetic Group 2, set forth in FIG. 28, and wherein the second C-lobe domain is obtained from any one of the C-lobe domains selected from a *Mannheimia haemolytica* strain belonging to a phylogenetic Group 1, or Group 3, set forth in FIG. 28.

In further preferred embodiments, at least two C-lobe domains obtainable or obtained from a TbpB protein are used, wherein both of the two C-lobe domains are obtainable or obtained from *Moraxella catharrhalis*. Referring to the phylogenetic tree set forth in FIG. 29, in preferred embodiments, at least two C-lobe domains are used, wherein a first C-lobe domain is obtained from any one of the C-lobe domains selected from a *Moraxella catharrhalis* bacterial strain belonging to phylogenetic Group 1, phylogenetic Group 2, or phylogenetic Group 3 set forth in FIG. 29, and wherein the second C-lobe domain is obtained from any one of the *Moraxella catharrhalis* strains belonging to a phylogenetic Group set forth in FIG. 29 other than the phylogenetic Group the first C-lobe domain is selected from. Thus by way of example only, a TbpB C-lobe domain obtained from *Moraxella catharrhalis* strain AAC34279.1 (phylogenetic Group 3; FIG. 29, black arrow) may be combined with a TbpB C-lobe domain from strain AAD12263.1 (phylogenetic Group 1; FIG. 29, black arrow). In further preferred embodiments, at least three C-lobe domains are used wherein the C-lobe domains are selected from strains belonging to three different Groups set forth in FIG. 29 (i.e. a C-lobe domain selected from each phylogenetic Group 1, phylogenetic Group 2 and phylogenetic Group 3). Thus by way of specific example only, a TbpB C-lobe domain from a *Moraxella catharrhalis* strains AAC34279.1 (phylogenetic Group 3; FIG. 29, black arrow), AAD12263.1 (phylogenetic Group 1; FIG. 29, black arrow), and 003664398.1 (phylogenetic Group 2; FIG. 29, black arrow) may be selected.

In particularly preferred embodiments, the aforementioned mixtures of polypeptides comprising or consisting of C-lobe domains are C-lobe domains obtainable or obtained from TbpB polypeptides, including, without limitation the C-lobe domains set forth in SEQ.ID NO: 5; SEQ.ID NO: 6; SEQ.ID NO: 22; SEQ.ID NO: 33; SEQ.ID NO: 34; SEQ.ID NO: 119; SEQ.ID NO: 125; SEQ.ID NO: 179 to SEQ.ID NO: 195; and SEQ.ID NO: 213 to SEQ.ID NO: 218; SEQ.ID NO: 230; SEQ.ID NO: 232; and SEQ.ID NO: 234 to SEQ.ID NO: 278.

The foregoing mixtures of C-lobe domains may be prepared by mixing preparations comprising the individual C-lobe domains or by recombinantly producing fusion polypeptides comprising two or more C-lobe domains.

As hereinbefore mentioned, the immunogenic preparations of the present disclosure are preferably cross-reactive and/or cross-protective. While, as hereinbefore mentioned, formulations comprising single C-lobe domains may be cross-reactive and/or cross-protective, mixtures of C-lobe domains are particularly preferred, in that they may be used to prepare immunogenic formulations that substantially broaden cross-reactivity and/or cross-protection against a wider range of bacterial strains and/or species, and allow the preparation of vaccine formulations providing protection from infection or disease transmitted by a plurality of bacterial species or bacterial strains.

Figure 8:
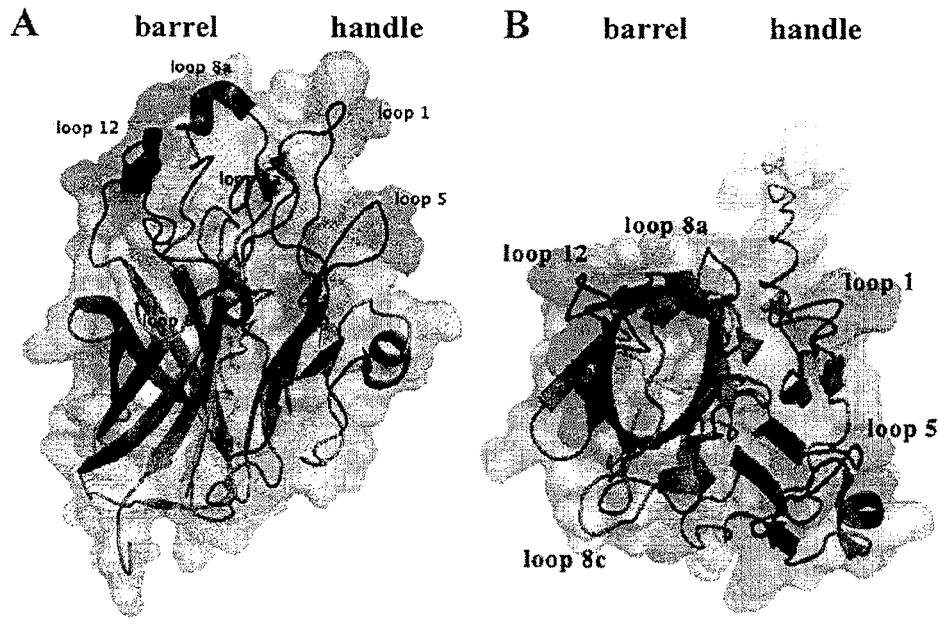
FIG. 8 depicts the loop regions of the *Actinobacillus pleuropneumoniae* strain H49 TbpB N-lobe (labeled "loop 1"; "loop 5"; "loop 8a"; "loop 8c" and "loop 12") (SEQ. ID. NO: 42; SEQ.ID NO: 50; SEQ.ID NO: 56; and SEQ.ID NO: 64, respectively) targeted for loop reduction and the sequences of the original and modified loops. Loop 8a and loop 8c refer to portions of loop 8 present in the TbpB from strain H49. Panel A is a structural model of the *Actinobacillus pleuropneumoniae* TbpB N-lobe viewed from the side (relative to the predicted dominant orientation at the cell surface) with the targeted regions labeled. Panel B is the same structural model viewed from the top to illustrate the association of loops 1 and 5 with the handle domain and loops 8a, 8c and 12 associated with the barrel domain. Panel C is an alignment of the native TbpB (SEQ.ID NO: 316) and the TbpB with reductions in the targeted loop regions (SEQ.ID NO: 317). The regions of the sequence encoding the loops are highlighted in grey and labeled with the loop numbers.

In accordance with other embodiments, a polypeptide comprising a C-lobe domain and/or an N-lobe domain of an HIBP surface receptor polypeptide is prepared in such a manner that a loop domain connecting two β-strands within the C-lobe domain or the N-lobe domain is modified and the polypeptide is unable to substantially bind host iron binding protein. The term "modified" as used herein in conjunction with a loop domain refers to a loop from which at least one amino acid residue has been removed or replaced. Thus the resultant loop within the C-lobe domain or the N-lobe domain may be truncated or, in other embodiments the amino acid residue, residues may be replaced with one or more alternate amino residues. FIG. 1 and FIG. 2 show the loop domains of exemplary HIBP surface receptor proteins. FIG. 8 and FIG. 14 provide examples of loop reductions in the N-lobe domain and C-lobe domain, respectively. In accordance herewith at least one of the loop domains connecting two β-strands within the C-lobe domain or the N-lobe domain of the HIBP binding membrane receptor protein is modified to remove at least one amino acid residue from the loop domains, the resulting polypeptide comprising a modified N-lobe domain or C-lobe domain and unable to substantially bind host iron binding protein. In other embodiments more amino acid residues are removed e.g. at least 5, 10, 15, 20, 25, 30, 35, 40, 45, 50, 60, 70, 80, 90, 100 amino acid residues are removed from the loop domain. In other embodiments the loop domain is removed in its entirety. Any of the loop domains may be selected to be modified in accordance with the present disclosure, provided such modification results in a polypeptide that is unable to substantially bind to the host iron binding protein. Thus, referring to the exemplary porcine TbpB polypeptide of FIG. 1, in embodiments of the present disclosure where one loop domain is modified, such loop domain may be selected to be any one of the loop domains L1-L32 (as exemplified by the *Actinobacillus pleuropneumoniae* loops L1-L32 polypeptide sequences: SEQ.ID: NO 42; SEQ.ID: NO 44; SEQ.ID: NO 46; SEQ.ID: NO 48; SEQ.ID: NO 50; SEQ.ID: NO 52; SEQ.ID: NO 54; SEQ.ID: NO 56; SEQ.ID: NO 58; SEQ.ID: NO 60; SEQ.ID: NO 62; SEQ.ID: NO 64; SEQ.ID: NO 66; SEQ.ID: NO 68; SEQ.ID: NO 70; SEQ.ID: NO 72; SEQ.ID: NO 74; SEQ.ID: NO 76; SEQ.ID: NO 78; SEQ.ID: NO 80; SEQ.ID: NO 82; SEQ.ID: NO 84; SEQ.ID: NO 86; SEQ.ID: NO 88; SEQ.ID: NO 90; SEQ.ID: NO 92; SEQ.ID: NO 94; SEQ.ID: NO 96; SEQ.ID: NO 98; SEQ.ID: NO 100; SEQ.ID: NO 102; SEQ.ID: NO 104; and SEQ.ID: NO 106, respectively, and encoded by the nucleic acid sequences SEQ.ID: NO 41; SEQ.ID: NO 43; SEQ.ID: NO 45; SEQ.ID: NO 47; SEQ.ID: NO 49; SEQ.ID: NO 51; SEQ.ID: NO 53; SEQ.ID: NO 55; SEQ.ID: NO 57; SEQ.ID: NO 59; SEQ.ID: NO 61; SEQ.ID: NO 63; SEQ.ID: NO 65; SEQ.ID: NO 67;

SEQ.ID: NO 69; SEQ.ID: NO 71; SEQ.ID: NO 73; SEQ.ID: NO 75; SEQ.ID: NO 77; SEQ.ID: NO 79; SEQ.ID: NO 81; SEQ.ID: NO 83; SEQ.ID: NO 85; SEQ.ID: NO 87; SEQ.ID: NO 89; SEQ.ID: NO 91; SEQ.ID: NO 93; SEQ.ID: NO 95; SEQ.ID: NO 97; SEQ.ID: NO 99; SEQ.ID: NO 101; SEQ.ID: NO 103; and SEQ.ID: NO 105, respectively), as further set forth in Table 1. In embodiments of the disclosure wherein two loop domains are modified, such two loop domains may be any two loop domains selected from the loop domains L1-L32 domains (again referring to the exemplary TbpB polypeptide of FIG. 1), as further set forth in Table 2. In embodiments of the disclosure wherein three loop domains are modified, such three loop domains may be any three loop domains selected from the loop domains L1-L32 domains (again referring to the exemplary TbpB polypeptide of FIG. 1), as further set forth in Table 3. In embodiments of the disclosure wherein four loop domains are modified, such four loop domains may be any three loop domains selected from the combination of loops set forth in Table 3 plus one additional loop domain selected from the loop domains L1-L32 (again referring to the exemplary TbpB polypeptide of FIG. 1). In other embodiments a total of 5, 6, 7, 8, 9, 10, 11, 12, 13, 14, 15, 16, 17, 18, 19, 20, 21, 22, 23, 24, 25, 26, 27, 28, 29, 30, 31 or 32 loop domains may be modified. It will be clear to those of skill in the art that the exact number of modified loop domains may vary and may be selected to be any 5, 6, 7, 8, 9, 10, 11, 12, 13, 14, 15, 16, 17, 18, 19, 20, 21, 22, 23, 24, 25, 26, 27, 28, 29, 30, 31 or 32 loop domains selected from the loops L1-L32, in each of these embodiments of the present disclosure, in a manner similar to the selection of loop domains described with respect to the embodiments in which 2 or 3 loop domains have been modified. In particularly preferred embodiments, one or all of loops L18, L21, L23 and L27 (as exemplified by the *Actinobacillus pleuropneumoniae* SEQ.ID NO: 76; SEQ.ID NO: 82; SEQ.ID NO: 86; and SEQ.ID NO: 96, respectively) of the C-lobe domain are modified. In further particularly preferred embodiments, one or all of loop L 1, L5, L8 and L12 (as exemplified by the *Actinobacillus pleuropneumoniae* SEQ.ID NO: 42; SEQ.ID NO: 50; SEQ.ID NO: 56; SEQ.ID NO: 64, respectively) of the N-lobe domain are modified. Loop domains that may be modified are loop domains that connect two 3-strands assembled within a β-barrel or handle domain β-sheet of the C-lobe domain or N-terminal lobe domain, or loop domains that connect two assembled β-strands, or a combination of the foregoing. In order to truncate a loop domain within the C-lobe domain or the N-terminal lobe domain, the polypeptide may be prepared in such a manner that the loop domain is removed in its entirety, and optionally replaced with one or more linking amino acid, thus resulting in a more or less direct connection between two β-strands, or in such a manner that a portion or portions of a loop domain are removed. In accordance herewith preferably at least half of the amino acid residues from at least one of the loop domains of the C-lobe domain or the N-lobe domain is removed. In further preferred embodiments, at least one half of the total amino acid residues of the loop domain are removed. Thus in such embodiments where a loop domain comprises for example 40 amino residues, at least 20 amino acid residues of the loop domain will be removed. In further embodiments, the loop domain is modified in such a manner that at least 60%, 70%, 80% or 90% of the amino acid residues of the loop domain are removed. In other embodiments up to 1, 2, 3, 4, 5, 6, 7, 8, 9, or 10 amino acids of the loop domains are retained, following truncation, and in yet other embodiments up to 10%, 20%, 30%, 40%, 50%, 60%, 70%, 80% or 90% of the loop domains are retained following truncation. In embodiments where the loop domain is modified in such a manner that only a portion of the loop domain is removed, the removed amino acid residues may be located at the N-terminal end of the loop domain, at the C-terminal end of the loop domain or in between the N- and C-termini. In embodiments were a plurality of loop domains of the C-lobe domain or the N-lobe domain are modified, such loop reductions may involve the removal of an identical number of amino acid residues from each loop, for example 10 amino acid residues from each loop within the C-lobe domain or the N-lobe domain may be removed, or the loop reduction may involve the removal of different amounts of amino acid residues from each loop, for example 10 residues in one loop and 20 residues in another loop.

Figure 23:
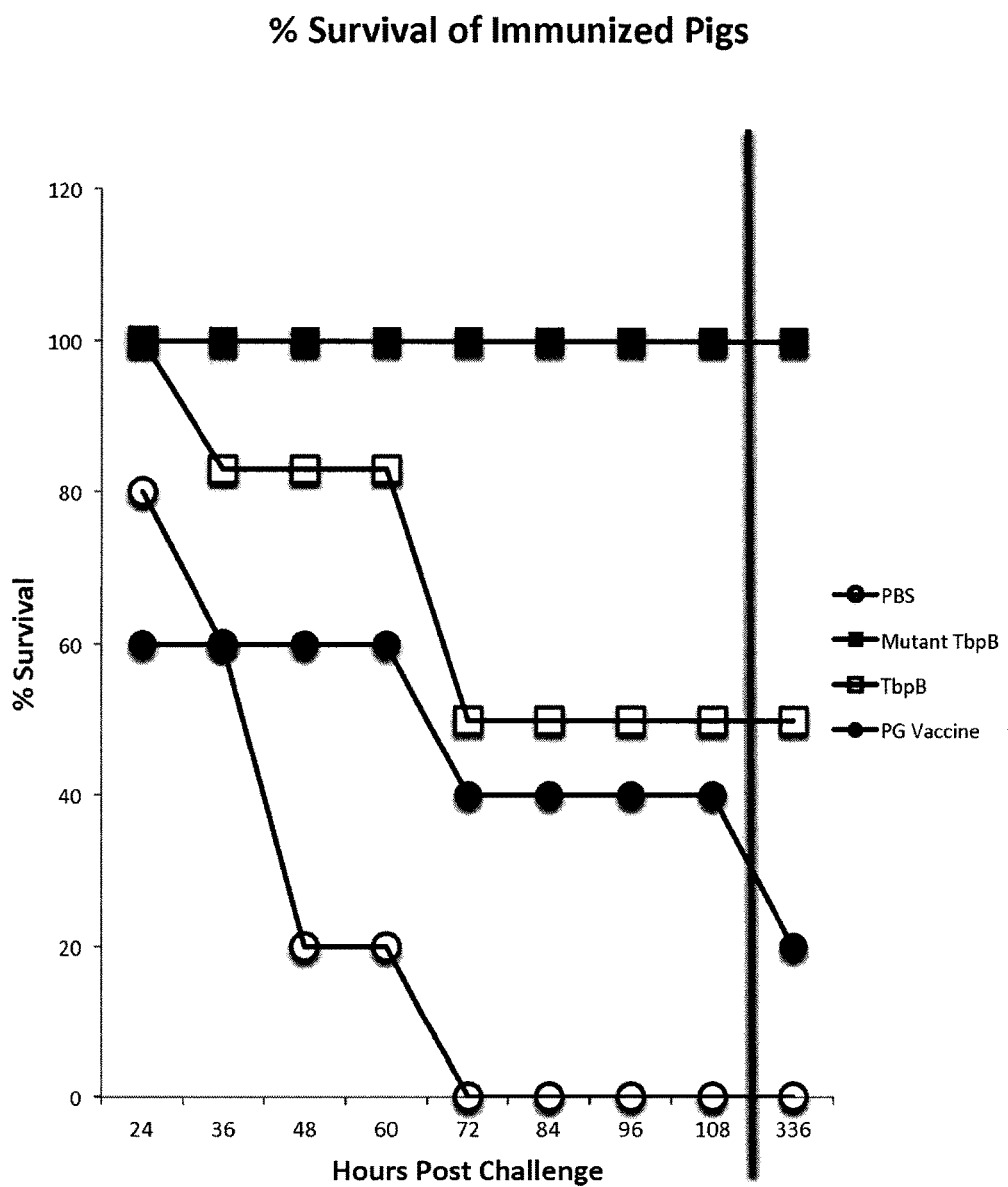
Figure 24:
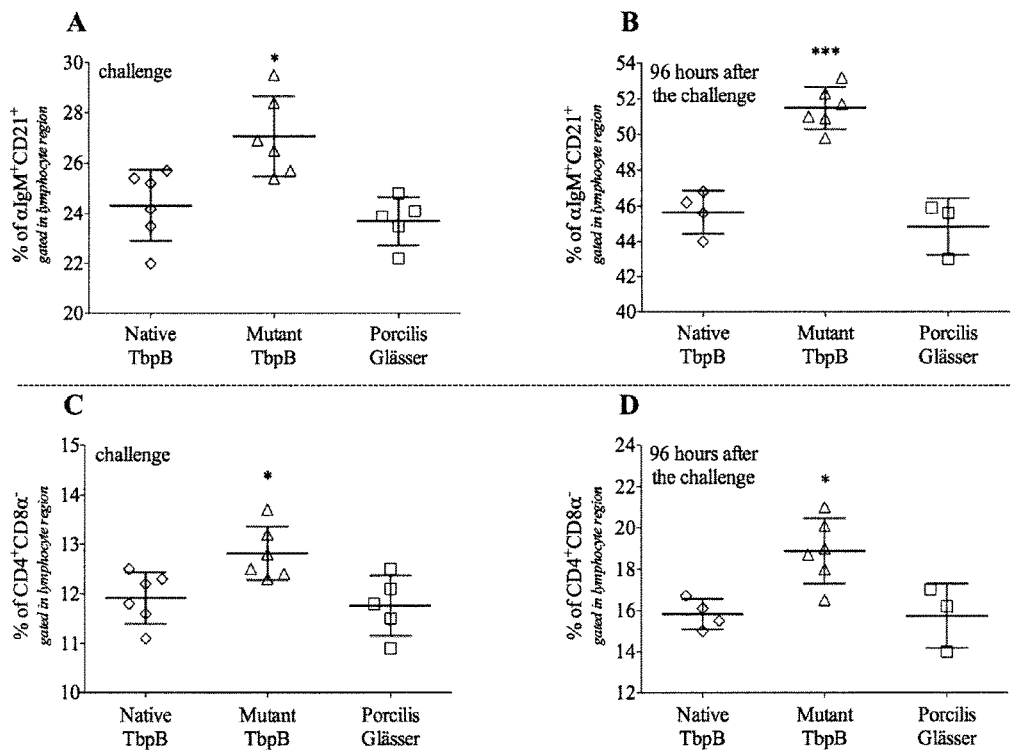

In further preferred embodiments, amino acid residues within the loop domains of the C-lobe domain and/or N-lobe domain are replaced by others e.g. by site directed mutagenesis, the resulting polypeptide comprising a modified C-lobe domain or N-lobe domain and unable to substantially bind host iron binding protein. FIG. 22 provides examples of residue replacements in N-lobe domain loop regions of various TbpB polypeptides and FIG. 23 illustrates the reduction in Tf binding due to these residue replacements. Thus, for example, one or more amino acid residues may be replaced in any one of loops L1-L32. In certain preferred embodiments, one or more amino acid residues are replaced in loop domain L1, L3, L5 or L8 of the N-lobe domain (as exemplified by the *Actinobacillus pleuropneumoniae* SEQ.ID NO: 42; SEQ.ID NO: 46; SEQ.ID NO: 50; and SEQ.ID NO: 56, respectively). In preferred embodiments, an aromatic amino acid (phenylalanine, tyrosine, and tryptophan) within loop domain L8 is replaced with an aliphatic amino acid (glycine, valine, leucine, isoleucine). These are surface accessible aromatic amino acid residues in an otherwise generally cationic surface region. In particularly preferred embodiments, an *Haemophilus parasuis* TbpB polypeptide is selected and one or more of the following mutations is made in the TbpB polypeptide to obtain a modified TbpB polypeptide: Y93A (SEQ.ID NO: 170; SEQ.ID NO: 171); Y117A (SEQ.ID NO: 172; SEQ.ID NO: 173); Y167A (SEQ.ID.NO: 174; SEQ.ID NO: 175) or W176A (SEQ.ID NO: 176; SEQ.ID NO: 177), and in further preferred embodiments an *Actinobacillus pleuropneumoniae* TbpB polypeptide is selected and one or more of the following mutations is made in the polypeptide to obtain a modified TbpB polypeptide: F171A (SEQ.ID NO: 3; SEQ.ID NO: 4); Y95A (SEQ.ID NO: 13; SEQ.ID NO: 14); Y121A (SEQ.ID NO: 15; SEQ.ID NO: 16); Y174A (SEQ.ID NO: 17; SEQ.ID NO: 18); or R179E (SEQ.ID NO: 19; SEQ.ID NO: 20), and in further preferred embodiments an *Actinobacillus suis* TbpB polypeptide is selected and one or more of the following mutations is made in the polypeptide to obtain a modified TbpB polypeptide: F63A (SEQ.ID NO: 29; SEQ.ID NO: 30) or F152A (SEQ.ID NO: 31; SEQ.ID NO: 32) The present disclosure includes each of the aforementioned modified polypeptides and nucleic acid sequences encoding these polypeptides, as well as immunogenic compositions and vaccine compositions comprising these polypeptides.

The reductions in size of one or more loop domains, or modification of amino acids in the loop domain of the HIBP polypeptides in accordance with the present disclosure are preferably made in such a manner that the resultant polypeptide is conformationally stable. By the term "conformationally stable" it is meant that the conformational state or conformation of the polypeptide remains substantially the same following the modification in size of the loop or replacement of amino acid residue. The conformational state of the loop domain which is modified may be more or less altered. The determinants of conformational state or confirmation of a polypeptide include: the polypeptide's primary structure as reflected in its amino acid sequence, the polypeptide's secondary structure (e.g. α-helix, β-sheet and the like), the polypeptide's tertiary structure (i.e. the three dimensional folding of the polypeptide chain) and the quaternary structure (i.e. the interaction of the polypeptide with other protein subunits). Protein conformation can further be influenced by environmental factors, such as pH, osmolarity, ionic strength and salt concentration. The design of loop reduction may be informed by the alignment and comparison of multiple heterologous sequences, the comparison of three-dimensional conformational structures of multiple heterologous polypeptides known to the art, and the use of conservative amino acid substitutions (e.g. combinations such as gly, ala; val, ile; leu, met; asp, glu; asn, gin; ser, thr; lys, arg; cys, met; and phe, trp, tyr). Furthermore, the conformational state of a protein may be assayed by a functional assay (e.g. binding of a host iron binding protein), or by physical methods such as X-ray crystallography or Nuclear Magnetic Resonance (NMR).

In further embodiments, at least one loop domain of the C-lobe domain or the N-lobe domain of an HIBP-surface receptor protein comprising the longest loop, is selected to be modified. In embodiments, wherein such a loop is modified in its entirety this generally will involve the removal of at least 25 amino acid residues and may result in the removal of 150 amino acid residues or more.

In preferred embodiments, at least one loop domain of the C-lobe domain or the N-lobe domain of an HIBP-surface receptor protein comprising the longest loop (i.e. comprising the most amino acid residues) of the C-lobe domain or the N-lobe domain is modified. In a further preferred embodiment, at least one loop domain of the C-lobe domain or the N-lobe domain of an HIBP-surface receptor protein comprising the longest loop of the C-lobe domain or the N-lobe domain is modified, and a second loop domain of the C-lobe domain or the N-lobe domain of an HIBP-surface receptor protein comprising the second longest loop are selected to be modified. In further preferred embodiments, at least one loop domain of the C-lobe domain or the N-lobe domain of an HIBP-surface receptor protein comprising the longest loop, and a second loop domain of the C-lobe domain or the N-lobe domain of an HIBP-surface receptor protein comprising the second longest loop are selected to be modified and a third loop domain of the C-lobe domain or the N-lobe domain of an HIBP-surface receptor protein comprising the third longest loop are selected to be modified. In yet further preferred embodiments, at least one loop domain of the C-lobe domain or the N-lobe domain of an HIBP-surface receptor protein comprising the longest loop, and a second loop domain of the C-lobe domain or the N-lobe domain of an HIBP-surface receptor protein comprising the second longest loop are selected to be modified and a third loop domain of the C-lobe domain or the N-lobe domain of an HIBP-surface receptor protein comprising the third longest loop are selected to be modified, and a fourth loop domain of the C-lobe domain or the N-lobe domain of an HIBP-surface receptor protein comprising the fourth longest loop are selected to be modified. The aforementioned embodiments are further detailed in Examples 3 and 4 hereto.

Surprisingly, in accordance herewith, it has been found that a polypeptide substantially consisting of a C-lobe domain or an N-lobe domain of a HIBP surface receptor protein can readily be produced, for example in a microbial production system, when one or more loop domains are modified, and the modified polypeptide is substantially conformationally stable.

In accordance herewith, the modified C-lobe domain or the N-lobe domain polypeptide may be used per se as an immunogen, or the polypeptide may be modulated to comprise further modifications. Modifications to the modified C-lobe domain or N-lobe domain of the polypeptide that may be made in accordance herewith include the preparation of N-terminal or C-terminal polypeptide extensions of the native or the modified C-lobe domain or N-lobe domain polypeptide. Such N-terminal and C-terminal polypeptide extensions include the addition of a second full length C-lobe domain polypeptide to the C-lobe domain, thus providing a C-lobe domain dimer, the addition of a second full length N-lobe domain polypeptide to the N-lobe domain, thus providing an N-lobe domain dimer, or an addition comprising a portion of a C-lobe domain polypeptide or a portion of an N-lobe domain polypeptide. Multimers may be assembled using the same monomeric polypeptide (i.e. homodimers, homotrimers etc.), or they may be assembled using different polypeptides, e.g. a C-lobe domain or an N-lobe domain obtained from different variants (i.e heterodimers, heterotrimers etc.). In preferred embodiments, heteromultimeric proteins representing different pathogens or pathogenic strains are assembled. Thus in one preferred embodiment, a heteromultimeric polypeptide comprising C-lobe domains or N-lobe domains selected from the group consisting of *Actinobacillus pleuropneumoniae*, *Actinobacillus suis* and *Haemophilus parasuis* C-lobe domains or N-lobe domains is prepared. In particularly preferred embodiments, the C-lobe domains or N-lobe domains are selected from the group consisting of *A. pleuropneumoniae* H49, *A. suis* H57 and *A. pleuropneumoniae* H87 C-lobe domains or N-lobe domains. In a further preferred embodiment, a heteromultimeric polypeptide comprising C-lobe domains selected from at least two TbpB C-lobe domains or N-lobe domains selected from strains of *Neisseria meningitidis* is prepared. In particularly preferred embodiments, the strains are selected from *N. meningitidis* M982 or *N. meningitidis* B16B6. Heteromultimeric proteins may convey immunogenicity to different pathogens. In further preferred embodiments the present disclosure provides, (i) a first polypeptide, comprising an N-lobe domain or a C-lobe domain of an HIBP surface receptor protein obtainable from or obtained from a Gram-negative pathogenic bacterial species, wherein the N-lobe domain or the C-lobe domain comprise a plurality of β-strands connected by a plurality of loop domains, and wherein at least one loop domain of the plurality of loop domains of the N-lobe domain or the C-lobe domain has been modified, linked to (ii) a second polypeptide comprising an HIBP surface receptor protein, or a portion thereof, obtainable from a Gram-negative bacterial species. In preferred embodiments, the portion of the HIBP surface receptor protein is an N-lobe domain or a C-lobe domain. In further preferred embodiments, the portion of the HIBP surface protein is an N-lobe domain or a C-lobe domain of an HIBP surface receptor protein obtainable from or obtained from a Gram-negative pathogenic bacterial species, wherein the N-lobe domain or the C-lobe domain comprise a plurality of β-strands connected by a plurality of loop domains, and wherein at least one loop domain of the plurality of loop domains of the N-lobe domain or the C-lobe domain has been modified.

In further embodiments, a multimeric polypeptide is prepared, such multimeric protein comprising a plurality of N- and C-terminal extensions, including the addition of a second, third, fourth, fifth, sixth or seventh full length C-lobe domain polypeptide to the C-lobe domain, thus providing a C-lobe domain multimer, or the addition of a second, third, fourth, fifth, sixth or seventh, full length N-lobe domain polypeptide to the N-lobe domain, thus providing an N-lobe domain dimer, or an addition comprising a portion of a C-lobe domain polypeptide or a portion of an N-lobe domain polypeptide. Thus for example, in one embodiment, the C-lobe domains are at least two, or at least three, C-lobe domains obtainable from a TbpB polypeptide obtainable from *A. pleuropneumoniae, A. suis* and *Haemophilus parasuis*. In accordance with such embodiment, the nucleic acid sequences encoding the TbpB C-lobe domains from *A. pleuropneumoniae* H49 (SEQ.ID NO: 5), *A. suis* H57 (SEQ.ID NO: 33) and *A. pleuropneumoniae* H87 (SEQ.ID NO: 21) may be linked to form a chimeric nucleic acid sequence (SEQ.ID NO: 39) encoding a single polypeptide (SEQ.ID NO: 40) encompassing the three C-lobes (SEQ.ID NO: 6; SEQ.ID NO: 34; SEQ.ID NO: 22). Accordingly, in yet further embodiments, the present disclosure provides (i) a first polypeptide, comprising an N-lobe domain or a C-lobe domain of an HIBP surface receptor protein obtainable from or obtained from a Gram-negative pathogenic bacterial species, wherein the N-lobe domain or the C-lobe domain comprise a plurality of β-strands connected by a plurality of loop domains, and wherein at least one loop domain of the plurality of loop domains of the N-lobe domain or the C-lobe domain has been modified, linked to (ii) a plurality of polypeptides each polypeptide comprising an HIBP surface receptor protein, or a portion thereof, obtainable from a Gram-negative bacterial species. In preferred embodiments the portion of the HIBP surface receptor protein is an N-lobe domain or a C-lobe domain. In further preferred embodiments, the portion of the HIBP surface protein is an N-lobe domain or a C-lobe domain of an HIBP surface receptor protein obtainable from or obtained from a Gram-negative pathogenic bacterial species, wherein the N-lobe domain or the C-lobe domain comprise a plurality of β-strands connected by a plurality of loop domains, and wherein at least one loop domain of the plurality of loop domains of the N-lobe domain or the C-lobe domain has been modified.

In further embodiments, upon removal of one or more amino acids from one or more loop domains of the C-lobe or N-lobe of an HIBP surface receptor protein, these residues are replaced with one or more alternate amino acid residues. In one embodiment, the alternate amino acid residues comprise a heterologous polypeptide antigenic determinant capable of eliciting an immune response in a vertebrate host organism. In further embodiments the alternate amino acid residues comprise two or more heterologous polypeptide antigenic determinants capable of eliciting an immune response in a vertebrate host organism. The heterologous antigenic determinants may be immuno-cross-reactive to the same or a different pathogenic organism. Thus it will be clear that the modified C-lobe domain or N-lobe domain of an HIBP surface receptor protein in accordance herewith may be used as a scaffold to produce and present one or more antigenic determinants. In a preferred embodiment, one or more loop regions of the C-lobe domain or the N-lobe domain of TbpB is replaced with one or more polypeptide portions obtainable from or obtained from an IOM protein, including a transferrin binding protein ("TbpA") or lactoferrin binding protein A ("LbpA"). LbpA and TbpA polypeptides that may be used in accordance herewith include those set forth in SEQ.ID NO: 162 and SEQ.ID NO: 152. Portions of LbpA and TbpA polypeptides that may be used in accordance herewith include those set forth in SEQ.ID NO: 286 and SEQ.ID NO: 287. These fragments may be used to construct chimeric nucleic acid sequences and polypeptides, including those set forth in SEQ.ID. NO: 163; SEQ.ID. NO: 164; SEQ.ID. NO: 165; SEQ.ID. NO: 166, SEQ.ID. NO: 167; and SEQ.ID. NO: 168. This embodiment of the disclosure is further detailed in Examples 7 and 8. hereto. In a further preferred embodiment, one or more loop domains of the C-lobe or N-lobe of TbpB is replaced with a lysine rich polypeptide sequence, as further described in Example 9.

In all of the hereinbefore described embodiments which comprise an HIBP surface receptor polypeptide comprising a N-lobe domain, it is preferable that, the N-lobe domain is modified in such a manner that the N-terminal anchor polypeptide, or a substantial portion thereof, is removed from the N-lobe domain. The length of the anchor polypeptide may vary depending on the HIBP surface receptor polypeptide, but typically ranges from 40 to 75 amino acids in length, and located at the N-terminal end of the mature HIPB polypeptide. Thus referring to FIG. 1, the anchor polypeptide of the therein depicted mature TbpB polypeptide is 43 amino acids in length. Accordingly, in preferred embodiments hereof comprising a HIBP polypeptide comprising an N-lobe domain, the anchor polypeptide is reduced in length by at least 10 amino acid residues, preferably at least 15, 20, 25, 30, 35, 40, 45, 50, 55, 60, 65, 70 or 75 residues. In embodiments where a portion of the anchor polypeptide is selected for reduction in length, preferably a contiguous portion of the N-terminus of the anchor polypeptide, e.g. the 10 terminal amino acid residues of the anchor peptide, are removed, however other portions of the anchor polypeptide may also removed. In further preferred embodiments, the TbpB polypeptide from which the anchoring peptide has been truncated includes SEQ.ID NO: 279 to SEQ.ID NO: 283. The inventors of the present disclosure have found that the foregoing embodiments are particularly desirable, since the removal of the anchor polypeptide reduces aggregation of the modified HIBP surface receptor polypeptide, rendering the polypeptide easier to produce, without however substantially impacting the immunogenic properties of the polypeptide. Thus this modification of an HIBP polypeptide may be used in conjunction with any of the modified peptides that are substantially unable to substantially bind host iron binding protein set forth herein, including the herein described HIBP polypeptides comprising a N-lobe domain or C-lobe domain comprising a modified loop domain, and HIBP polypeptides comprising a N-lobe or C-lobe domain where a single amino acid has been replaced in a such a manner that the HIBP polypeptide is substantially unable to bind host iron bing protein.

As hereinbefore mentioned, in accordance with the present disclosure the HIBP surface receptor protein is modified in such a manner that it is unable to substantially bind host iron binding protein. The binding of host iron binding protein to the modified HIBP surface receptor protein may be evaluated using any chemical or biochemical assay capable of evaluating such binding including, for example, a solid phase binding assay, an affinity capture assay, or a biophysical assay. General methodologies to conduct these assays are known to those of skilled in the art and described in for example (12, 23-25, 50, 51). By conducting these assays the difference in binding characteristics between the native HIBP surface receptor protein and the native host iron binding protein, and the modified HIBP surface receptor protein and the native host iron binding protein, may readily be determined, and a series of modified HIBP surface receptor proteins may be evaluated in order to determine whether they are able to bind host iron binding protein. Different binding characteristics may be determined, including the binding constant (Kd). As hereinbefore mentioned, the Kd characterizing the binding between the host iron binding protein and the modified HIBP surface receptor proteins of the present disclosure is at least 2× higher than the Kd characterizing the binding between the host iron binding protein and the native HIBP surface receptor protein. One exemplary assay method to determine the binding constant using host transferrin is further described in Example 11 hereto.

The present disclosure further includes a method of identifying a modified HIBP surface receptor protein, the method comprising:
  (i) providing a modified HIBP surface receptor protein and a native HIBP surface receptor protein;
  (ii) determining the binding characteristics between the modified HIBP surface receptor protein and a host iron binding protein to obtain the binding characteristics of the modified HIBP surface receptor proteins;
  (iii) determining the binding characteristics between the native HIBP surface receptor protein and a host iron binding protein to obtain the native HIBP surface receptor protein binding characteristics;
  (iv) comparing the binding characteristics of the modified HIBP surface receptor protein characteristics with the native HIBP surface receptor protein characteristics; and
  (v) identifying an HIBP surface receptor protein exhibiting binding characteristics that are substantially modulated relative to the binding characteristics of the native HIBP surface receptor protein.

"Substantially modulated" as used herein means that the binding interaction forces between the modified HIBP surface receptor proteins and the host iron binding protein are substantially weaker than the binding interaction forces between the native HIBP surface receptor proteins and the host iron binding protein. In preferred embodiments, the binding characteristic that used is the Kd relating to the binding interaction of the HIBP surface receptor protein and the host iron binding protein, wherein the value of the Kd of the binding interaction between the modified HIBP surface receptor proteins and the host iron binding protein is at least 2× larger in value than the Kd of the binding interaction between the native HIBP surface receptor proteins and the host iron binding protein. It is further noted that foregoing method may be used to screen a plurality of different candidate HIBP surface receptor proteins, simultaneously or sequentially, and identifying among the screened candidate HIBP surface receptor proteins, those exhibiting a more or less pronounced modulation in binding characteristics relative to the native HIBP surface receptor proteins.

The present disclosure further includes a method of preparing a modified HIBP surface receptor protein for use as a vaccine, the method comprising:
  (i) providing a modified HIBP surface receptor protein and a native HIBP surface receptor protein;
  (ii) determining the binding characteristics between the modified HIBP surface receptor protein and a host iron binding protein to obtain the modified HIBP surface receptor proteins' binding characteristics;
  (iii) determining the binding characteristics between the native HIBP surface receptor protein and a host iron binding protein to obtain the native HIBP surface receptor protein binding characteristics;
  (iv) comparing the binding characteristics of the modified HIBP surface receptor protein with the binding characteristics of the native HIBP surface receptor protein;
  (v) identifying an HIBP surface receptor protein exhibiting binding characteristics that are substantially modulated relative to the binding characteristics of the native HIBP surface receptor protein; and
  (vi) preparing the modified HIBP surface receptor protein exhibiting binding characteristics that are substantially modulated relative to the binding characteristics of the native HIBP surface receptor protein for use as a vaccine.

In accordance with the foregoing, the identified HIBP surface receptor protein exhibiting substantially modulated binding characteristics relative to the binding characteristics of the native HIBP surface receptor proteins may be used to prepare immunogenic formulations, e.g. by recombinantly producing the HIBP surface receptor protein, isolating the HIBP surface protein, and preparing a vaccine formulation comprising the HIBP surface receptor protein.

In further embodiments, the present disclosure comprises methods of evaluating cross-reactivity of antisera against surface receptor protein variants. Accordingly the present disclosure further comprises a method of evaluating the cross-reactivity of antisera against surface receptor protein variants, the method comprising:
  (i) providing a plurality of nucleic acid sequences encoding surface receptor proteins;
  (ii) determining the nucleic acid sequence variation among the plurality of surface receptor proteins;
  (iii) selecting a variant portion of a surface receptor protein;
  (iv) linking a nucleic acid sequence encoding an N-terminal or C-terminal portion of the variant surface receptor protein to a nucleic acid sequence encoding a peptide susceptible to enzymatic biotinylation and a nucleic acid sequence capable of controlling expression in a host cell to form a chimeric nucleic acid sequence;
  (v) introducing the chimeric nucleic acid sequence into host cell and expressing the chimeric nucleic acid sequence to produce a fusion polypeptide comprising the N-terminal or C-terminal portion of the variant surface receptor protein fused to the peptide susceptible to biotinylation;
  (vi) preparing cellular lysates from the host cells;
  (vii) applying the cellular extracts to a streptavidin coated immunoassay substrate material; and
  (viii) applying an antiserum to the immunoassay substrate material, washing the immunoassay substrate material and applying labeled second conjugates in order to evaluate the cross-reactivity between the antiserum and the variant portion of the surface receptor protein.

The nucleic acid sequence encoding the peptide susceptible to biotinylation additionally may comprise a nucleic acid sequence of sufficient length to permit, upon expression, a polypeptide extension for the fusion polypeptide such that the surface receptor protein is distant from the immunoassay substrate material and thereby fully accessible to binding of an antibody. The streptavidin coated immunoassay substrate material may be any substrate material, including, for example, an ELISA plate.

In further embodiments, the present disclosure comprises methods of evaluating the cross-reactive or protective properties of antiserum surface receptor protein variants, the method comprising:
  (i) providing a plurality of nucleic acid sequences encoding surface receptor proteins;

(ii) determining the nucleic acid sequence variation among the plurality of surface receptor proteins;
(iii) providing a host cell comprising a counter-selectable marker capable of replacing a nucleic acid sequence encoding a surface receptor protein;
(iv) PCR amplifying a plurality of variant portions of one or more nucleic acid sequences encoding a surface receptor protein to obtain a plurality of PCR products encoding surface receptor variants, wherein PCR amplification is conducted in a manner that permits integration of the PCR products into the host cell comprising a counter-selectable marker, and wherein the PCR products comprise a unique extraneous nucleic acid sequence in order permit identification of each PCR product;
(v) introducing and expressing the plurality of PCR products into the host cell comprising the counter-selectable marker to provide a library of antigenic HIBP variants; and
(vi) using all or a portion of the library in an in-vivo or in-vitro immunological assay to assess the cross-reactive or cross-protective properties of the library or portion thereof.

The in-vivo or in-vitro immune assay may be any assay including any ELISA assay, functional immunological assay or animal infection model.

In yet further embodiments, the present disclosure comprises a method of evaluating the efficacy of a vaccine for the prevention of colonization of the mammalian upper respiratory tract by a Gram-negative bacterial strain expressing a surface receptor protein variant, the method comprising:
(i) providing (a) a transgenic mouse line expressing a mammalian CEACAM receptor from the host species of the pathogen to which the vaccine is directed and (b) a mouse line genetically identical to the transgenic mouse line but not expressing the CEACAM receptor;
(ii) demonstrating that the Gram-negative bacterial strain expressing the variant surface receptor protein is capable of colonizing the upper respiratory tract of the transgenic mouse line, and is not capable of colonizing the upper respiratory tract of the mouse line not expressing the CEACAM receptor;
(iii) determining whether immunizing with antigens derived from the surface receptor protein result in the absence of colonization of the upper respiratory tract in transgenic mice infected with the Gram-negative bacterial strain expressing the surface receptor protein variant;
(iv) determining whether provision of antisera from animals immunized with antigens derived from the surface receptor protein result in the absence of colonization of the upper respiratory tract in non-transgenic immunized mice infected with the Gram-negative bacterial strain expressing the surface receptor protein variant
(v) preparing a library comprising portions of surface receptor protein from the Gram-negative bacterial strain and use the library in an animal upper respiratory tract colonization model to evaluate colonization of the upper respiratory tract of animals challenged with the surface receptor variants; and
(vi) optionally, extracting and preparing DNA obtained from the library used to challenge the animal and/or from samples obtained from the challenged animals at appropriate time periods after exposure, and determine the proportion of strains expressing different receptor variants.

In general, it will be understood by a person of ordinary skill in the art, having read the current disclosure, that in accordance with the disclosure a series of different modulated polypeptides may be prepared and obtained, all of which, are modified HIBP surface receptor proteins, wherein the modification is made in such a manner that the modified HIBP surface receptor protein is unable to substantially bind host iron binding protein. These modulated polypeptides and methods of making such modulated polypeptides are all intended to be included within the scope of the compositions and methods herein provided.

The modified C-lobe domain or N-lobe domain polypeptides are conveniently prepared by providing a nucleic acid sequence encoding an HIBP surface receptor protein, and modulating the native nucleic acid sequence in such a manner that the polypeptides comprising the modified C-lobe domain or N-lobe domain are expressed in a recombinant host organism, for example a microbial cell. Modulations to the nucleic acid sequence may be made using a variety of nucleic acid modification techniques that will be generally known to those skilled in the art, including for example site directed mutagenesis, targeted mutagenesis, random mutagenesis, the addition of organic solvents, gene shuffling or a combination of these and other techniques known to those of skill in the art, each methodology designed to target the loop domains of the C-lobe domain or N-lobe domain in such a manner that a loop domain therein is modified. Alternatively the modulated nucleic acid sequences encoding the modified in size-C-lobe domain or N-lobe domain polypeptides may be prepared ab initio using gene synthesis techniques. General techniques to prepare and modify nucleic acid sequences are readily available to the skilled artisan, for example in Green and Sambrook, Molecular Cloning, a Laboratory Manual, Cold Spring Harbor Laboratory Press, 2012, (33).

In other embodiments of the present disclosure, methods for preparing an immunogenic composition are provided. Accordingly, the present disclosure provides a method for preparing an immunogenic composition comprising:
(a) providing a chimeric nucleic acid sequence comprising as operably linked components:
(i) a nucleic acid sequence encoding a polypeptide comprising a C-lobe domain or N-lobe domain of an HIBP surface receptor protein obtainable from a Gram-negative bacterial species wherein the polypeptide has been modified in such a manner that it is unable to substantially bind host iron binding protein; and
(ii) a nucleic acid sequence capable of controlling expression in a recombinant host cell;
(b) introducing the chimeric nucleic acid sequence into a host cell and growing the host cell to produce the polypeptide comprising the C-lobe domain or N-lobe domain;
(c) recovering the polypeptide comprising C-lobe domain or N-lobe domain from the host cell; and
(d) preparing an immunogenic composition In certain embodiments the C-lobe domain or N-lobe domain comprises a plurality of β-strands connected by a plurality of loop domains, and wherein at least one loop domain of the plurality of loop domains has been modified, and wherein the polypeptide has been modified in such a manner that it is unable to substantially bind host iron binding protein.

In further preferred embodiments the present disclosure provides a method for preparing an immunogenic composition comprising:

(a) providing a chimeric nucleic acid sequence comprising as operably linked components:
  (i) a first nucleic acid sequence encoding a polypeptide comprising a first C-lobe domain or first N-lobe domain of an HIBP surface receptor protein obtainable from a Gram-negative bacterial species;
  (ii) a second nucleic acid sequence encoding a polypeptide comprising a second C-lobe domain or second N-lobe domain of an HIBP surface receptor protein obtainable from a Gram-negative bacterial species; and (iii) a nucleic acid sequence capable of controlling expression in a recombinant host cell;

(b) introducing the chimeric nucleic acid sequence into a host cell and growing the host cell to produce the polypeptide comprising the first and second C-lobe domain or first and second N-lobe domain;

(c) recovering the polypeptide comprising the first and second C-lobe domain or first and second N-lobe domain from the host cell; and (d) preparing an immunogenic composition.

In preferred embodiments, the first and second nucleic acids are operably linked in such a manner that a heteromultimeric fusion polypeptide comprising a first and second C-lobe domain or a first and second N-lobe domain are produced, and wherein the heteromultimeric fusion polypeptide is unable to substantially bind host iron binding protein.

In accordance herewith, the nucleic acid sequence encoding the HIBP surface receptor protein is linked to a nucleic acid sequence capable of controlling expression of the HIBP surface receptor protein in a host cell. Accordingly, the present disclosure also provides a nucleic acid sequence encoding the HIBP surface receptor protein linked to a promoter capable of controlling expression in a host cell. Nucleic acid sequences capable of controlling expression in host cells that may be used herein include any transcriptional promoter capable of controlling expression of polypeptides in host cells. Generally, promoters obtained from bacterial cells are used when a bacterial host is selected in accordance herewith, while a fungal promoter will be used when a fungal host is selected, a plant promoter will be used when a plant cell is selected, and so on. Further nucleic acid elements capable of controlling expression in a host cell include transcriptional terminators, enhancers and the like, all of which may be included in the chimeric nucleic acid sequences of the present disclosure.

In accordance with the present disclosure, the chimeric nucleic acid sequences comprising a promoter capable of controlling expression in a host cell linked to a nucleic acid sequence encoding a polypeptide comprising a C-lobe domain or N-lobe domain of an HIBP surface receptor protein obtainable from a Gram-negative bacterial species, wherein the C-lobe domain or N-lobe domain comprises a plurality of β-strands connected by a plurality of loop domains, and wherein at least one loop domain of the plurality of loop domains has been modified, can be integrated into a recombinant expression vector which ensures good expression in the host cell. Accordingly, the present disclosure includes a recombinant expression vector comprising as operably linked components:

(i) a nucleic acid sequence capable of controlling expression in a host cell; and (ii) a nucleic acid sequence encoding a polypeptide comprising a C-lobe domain or N-lobe domain of an HIBP surface receptor protein obtainable from or obtained from a Gram-negative bacterial species, wherein the polypeptide has been modified in such a manner that it is unable to substantially bind host iron binding protein.

wherein the expression vector is suitable for expression in a host cell. The term "suitable for expression in a host cell" means that the recombinant expression vector comprises the chimeric nucleic acid sequence of the present disclosure linked to genetic elements required to achieve expression in a host cell. Genetic elements that may be included in the expression vector in this regard include a transcriptional termination region, one or more nucleic acid sequences encoding marker genes, one or more origins of replication and the like. The genetic elements are operably linked, typically as well be known to those of skill in the art, by linking e.g. a promoter in the 5' to 3' direction of transcription to a coding sequence. In preferred embodiments, the expression vector further comprises genetic elements required for the integration of the vector or a portion thereof in the host cell's genome. In further embodiments the C-lobe domain or N-lobe domain comprises a plurality of β-strands connected by a plurality of loop domains, and wherein at least one loop domain of the plurality of loop domains has been modified.

Pursuant to the present disclosure, the expression vector may further contain a marker gene. Marker genes that may be used in accordance with the present disclosure include all genes that allow the distinction of transformed cells from non-transformed cells, including all selectable and screenable marker genes. A marker gene may be a resistance marker such as an antibiotic resistance marker against, for example, kanamycin or ampicillin. Screenable markers that may be employed to identify transformants through visual inspection include, galactosidase, β-glucuronidase (GUS) (U.S. Pat. Nos. 5,268,463 and 5,599,670) and green fluorescent protein (GFP) (52).

One host cell that particularly conveniently may be used is *Escherichia coli*. The preparation of the *E. coli* vectors may be accomplished using commonly known techniques such as restriction digestion, ligation, ligation independent cloning, gel electrophoresis, DNA sequencing, the Polymerase Chain Reaction (PCR), and other methodologies. A wide variety of cloning vectors are available to perform the necessary steps required to prepare a recombinant expression vector including custom vectors that the inventors have developed. Among the vectors with a replication system functional in *E. coli*, are vectors such as the pUC or pET series of vectors, etc. Typically, these cloning vectors contain a marker allowing selection of transformed cells. Nucleic acid sequences may be introduced in these vectors, and the vectors may be introduced in *E. coli* by preparing competent cells, electroporation or using other well known methodologies to a person of skill in the art. *E. coli* may be grown in an appropriate medium, such as Luria-Broth medium and harvested. Recombinant expression vectors may readily be recovered from cells upon harvesting and lysing of the cells. Further, general guidance with respect to the preparation of recombinant vectors and growth of recombinant organisms may be found in, for example: Sambrook et al., Molecular Cloning, a Laboratory Manual, Cold Spring Harbor Laboratory Press, 2001, Third Ed (33).

The production of the recombinant proteins can occur throughout the growth of the *E. coli* strain, preferably by induction of expression after a period of growth to achieve a significant biomass. This will result in the production of the polypeptide comprising the C-lobe domain or N-lobe domain or the C-lobe domain or N-lobe domain with modified loops. The polypeptide subsequently may be recovered, isolated and separated from other host cell components by a variety of different protein purification techniques including, e.g. metal-chelate chromatography, ion-exchange chromatography, size exclusion chromatography, affinity chromatography, hydrophobic interaction chromatography, reverse phase chromatography, gel filtration, etc. Further general guidance with respect to protein purification may for example be found in: Protein Purification: Principles, High Resolution Methods, and Applications (53). The term "recovered" as used herein means that the polypeptides is obtained in more or less pure form. In preferred embodiments, a substantially immunogenic polypeptide comprising a C-lobe domain of an HIBP surface receptor protein obtainable from a Gram-negative bacterial species, wherein the C-lobe domain or N-lobe domain comprises a plurality of β-strands connected by a plurality of loop domains, and wherein at least one loop domain of the plurality of loop domains has been modified, may be obtained in accordance herewith. Thus the HIBP polypeptides obtained in accordance herewith may be prepared in substantially pure form. By "substantially pure" it is meant that the immunogenic protein is separated from other host cell components. In accordance here with the immunogenic protein is at least 95% pure, and more preferably at least 96%, 97%, 98% or 99% pure. Alternatively, relatively crude fractions comprising the HIBP polypeptide may be obtained, e.g. cells containing the polypeptides, cell lysates containing the polypeptides, or cellular fractions containing the polypeptide.

In further embodiments, the present disclosure provides methods for eliciting an immune response in a vertebrate subject. The immune response may be elicited by the delivery of the immunogenic protein or by the delivery of an expression vector comprising a nucleic acid sequence encoding the immunogenic protein. Accordingly, the present disclosure further provides a method for eliciting an immune response in a vertebrate subject, said method comprising administering to the subject:

(a) an immunogen comprising a polypeptide comprising a C-lobe domain or N-lobe domain of an HIBP surface receptor protein obtainable from a Gram-negative bacterial species, wherein polypeptide is unable to substantially bind host iron binding protein; or
(b) an expression vector comprising a nucleic acid sequence encoding an immunogen comprising a polypeptide comprising a C-lobe domain or N-lobe domain of an HIBP surface receptor protein obtainable from a Gram-negative bacterial species wherein the polypeptide is unable to substantially bind host iron binding protein; and wherein the immunogen is administered in, or is expressed in, an amount sufficient to elicit an immune response in the vertebrate subject.

The present disclosure also provides a use of:
(a) an immunogen comprising a polypeptide comprising a C-lobe domain or N-lobe domain of an HIBP surface receptor protein obtainable from a Gram-negative bacterial species, wherein polypeptide is unable to substantially bind host iron binding protein; or
(b) an expression vector comprising a nucleic acid sequence encoding an immunogen comprising a polypeptide comprising a C-lobe domain or N-lobe domain of an HIBP surface receptor protein obtainable from a Gram-negative bacterial species wherein the polypeptide is unable to substantially bind host iron binding protein;
for eliciting an immune response in a vertebrate subject.

The present disclosure further provides a use of:
(a) an immunogen comprising a polypeptide comprising a C-lobe domain or N-lobe domain of an HIBP surface receptor protein obtainable from a Gram-negative bacterial species, wherein polypeptide is unable to substantially bind host iron binding protein; or
(b) an expression vector comprising a nucleic acid sequence encoding an immunogen comprising a polypeptide comprising a C-lobe domain or N-lobe domain of an HIBP surface receptor protein obtainable from a Gram-negative bacterial species wherein the polypeptide is unable to substantially bind host iron binding protein;
in the manufacture of a medicament for eliciting an immune response in a vertebrate subject.

The present disclosure yet also provides:
(a) an immunogen comprising a polypeptide comprising a C-lobe domain or N-lobe domain of an HIBP surface receptor protein obtainable from a Gram-negative bacterial species, wherein polypeptide is unable to substantially bind host iron binding protein; or
(b) an expression vector comprising a nucleic acid sequence encoding an immunogen comprising a polypeptide comprising a C-lobe domain or N-lobe domain of an HIBP surface receptor protein obtainable from a Gram-negative bacterial species wherein the polypeptide is unable to substantially bind host iron binding protein;
for eliciting an immune response in a vertebrate subject.

In preferred embodiments, the polypeptide comprises at least two C-lobe domains, or at least two N-lobe domains. In further preferred embodiments, the polypeptide comprises at least three C-lobe domains, or at least three N-lobe domains.

In certain embodiments, the C-lobe domain or N-lobe domain comprises a plurality of β-strands connected by a plurality of loop domains, and wherein at least one loop domain of the plurality of loop domains has been modified in such a manner that the C-lobe domain or N-lobe domain is unable to substantially bind host iron binding protein.

The present disclosure further includes an immunogen comprising a C-lobe domain or an N-lobe domain of an HIBP surface receptor polypeptide wherein the C-lobe domain or the N-lobe domain comprises a plurality of β-strands connected by a plurality of loop domains, and wherein at least one loop domain has been modified for use as a medicament.

The present disclosure further includes an immunogen comprising a C-lobe domain or an N-lobe domain of an HIBP surface receptor polypeptide wherein the C-lobe domain or the N-lobe domain comprises a plurality of β-strands connected by a plurality of loop domains, and wherein at least one loop domain has been modified for use in the prevention of infection or disease by infectious Gram-negative bacteria, including bacteria belonging to the genus *Actinobacillus, Neisseria, Haemophilus, Mannheimia, Histophilus, Pasteurella* or *Moraxella*.

The present disclosure further includes an immunogen comprising a C-lobe domain or an N-lobe domain of an HIBP surface receptor polypeptide wherein the C-lobe domain or the N-lobe domain comprises a plurality of β-strands connected by a plurality of loop domains, and wherein at least one loop domain has been modified for use in the manufacture of a medicament for the prevention of infection or disease by infectious Gram-negative bacteria, including bacteria belonging to the genus *Actinobacillus, Neisseria, Haemophilus, Mannheimia, Histophilus, Pasteurella* or *Moraxella*.

Vaccine Preparations

The present disclosure further provides vaccine preparations. Thus, the present disclosure further provides a vaccine composition comprising an antigen derived from a HIBP surface receptor protein from a Gram-negative pathogenic bacterial species, wherein the protein derived from the HIBP surface receptor protein has been modified in such a manner that it is unable to substantially bind host iron binding protein. The vaccine compositions of the present disclosure preferably comprise a vaccine comprising a polypeptide comprising, an HIPB surface receptor protein, a C-lobe domain or N-lobe domain of an HIBP surface receptor protein obtainable from a Gram-negative pathogenic bacterial species wherein the polypeptide is modified in such a manner that it is unable to substantially bind host iron binding protein. In preferred embodiments, the vaccine preparation comprises a mixture of C-lobe domains belonging to two different bacterial species or two different bacterial strains. In further preferred embodiments, the polypeptide comprises at least two or at least three N-lobe domains or C-lobe domains. In further preferred embodiments, said at least two or at least three N-lobe domains or C-lobe domains form a heteromultimer. In further embodiments, the C-lobe domain or N-lobe domain comprises a plurality of β-strands connected by a plurality of loop domains, and wherein at least one loop domain of the plurality of loop domains has been modified.

The vaccine preparations of the present disclosure comprise the immunogenic HIBP polypeptides in more or less pure form. Thus, in accordance herewith, substantially pure HIBP polypeptides may be obtained and used to prepare vaccine formulations. In other embodiments more crude HIPB polypeptide preparations may be obtained and used to prepare vaccine formulations. Thus, for example, in such embodiments cells, cell lysates or cell fractions comprising the HIBP polypeptides may be used to prepare the vaccine formulations.

In order to augment an immune response in a subject, the compositions provided herein further preferably include adjuvants, such as pharmacological agents, cytokines, or the like. Suitable adjuvants include any substance that enhances the immune response of the subject to the immunogenic polypeptides of the disclosure. Non-limiting examples of adjuvants include cytokines, e.g., IL-1, IL-2, IL-12, IL-6, and further include inorganic salts, e.g. aluminum hydroxide, aluminum phosphate, and calcium phosphate; oil emulsions, eg. mineral oil, MF59, QS-21, Montamide ISA51 and ISA-720; Isocoms, eg. ISCOMATRIX; microbial derivatives, eg. MPLA, macrophage-activating protein-2, virosomes, LT/CT, CpG; natural polymers, eg. polysaccharides; and synthetic polymers, eg. polyanhydrides and polyesters, as reviewed in Wilson-Welder et al. (54). Adjuvants may be administered, for example, as proteins or other macromolecules at the same time, prior to, or subsequent to, administration of the polypeptide antigens.

Doses for immunogenic proteins, generally range from about 0.1 μg to about 20 mg, preferably 10 μg to about 3 mg for human subjects. The exact amount necessary, however, will vary depending on the age and general condition of the recipient subject to be treated, the severity of the condition being treated, the particular preparation delivered, the site of administration, as well as other factors. An appropriate therapeutically effective amount can be readily determined by one of skill in the art. Thus, a "therapeutically effective amount" of the present compositions will be an amount sufficient to bring about treatment or prevention of disease or condition symptoms, or to prevent colonization by the pathogenic bacteria, and will fall in a relatively broad range that can be determined through routine trials.

Vaccine preparations comprising the immunogenic composition of the present disclosure preferably further comprise vehicles, excipients and auxiliary substances, such as wetting or emulsifying agents, pH buffering substances and the like, may be present in the excipient or vehicle. These vehicles, excipients and auxiliary substances are generally pharmaceutical agents that do not induce an immune response in the recipient subject, and may be administered without undue toxicity. Pharmaceutically acceptable excipients include, but are not limited to, liquids such as water, saline, polyethyleneglycol, hyaluronic acid, glycerol and ethanol. Pharmaceutically acceptable salts can also be included therein, for example, mineral acid salts such as hydrochlorides, phosphates, sulfates, and the like; and the salts of organic acids such as acetates, propionates, benzoates, and the like. It is also preferred, although not required, that the preparation will contain a pharmaceutically acceptable excipient that serves as a stabilizer, particularly in order to stabilize the polypeptides of the present disclosure. Examples of suitable carriers that also act as stabilizers for peptides include, without limitation, pharmaceutical grades of dextrose, sucrose, lactose, sorbitol, inositol, dextran, and the like. Other suitable carriers include, again without limitation, starch, cellulose, sodium or calcium phosphates, citric acid, glycine, polyethylene glycols (PEGs), and combinations thereof.

The vaccine preparations of the present disclosure may be used to prevent infection or disease caused by infectious Gram-negative bacteria, including, without limitation, bacteria belonging to the genus *Actinobacillus, Neisseria, Haemophilus, Mannheimia, Histophilus, Pasteurella* or *Moraxella*, including without limitation *Actinobacillus pleuropneumoniae, Actinobacillus suis, Haemophilus parasuis, Neisseria meningitidis*. The vaccine preparations may be used to immunize any vertebrate subject including any vertebrate subject expressing host iron binding proteins and including, without limitation, any mammalian subject, including any human subject, porcine subject, bovine subject, equine subject, ovine subject, hircine subject, canine subject, feline subject, leporine subject and, further any ruminant subject, and murine subject. Other vertebrate subjects that may be immunized include any avian subject and piscine subject. The vaccine preparations of the present disclosure may exhibit an enhanced cross-reactive and/or cross-protective immunological response in the recipient host organism. It is further noted that the vaccine preparations of the present disclosure may prevent infection and/or colonization by the infectious Gram-negative bacteria, including bacterial colonization of the respiratory tract or genital tract of a vertebrate subject.

The present disclosure further includes a vaccine comprising an HIPB surface receptor protein, a C-lobe domain or an N-lobe domain of an HIBP surface receptor polypeptide wherein the C-lobe domain or the N-lobe domain comprises a plurality of β-strands connected by a plurality of loop domains, and wherein at least one loop domain has been modified for use in the prevention of infection or disease by infectious gram-negative bacteria, including bacteria belonging to the genus *Actinobacillus, Neisseria, Haemophilus, Mannheimia, Histophilus, Pasteurella* or *Moraxella.*

Testing Vaccine Preparations

In accordance herewith the efficacy of the vaccine preparations of the present disclosure may be evaluated, for example by determining the antibody titre present in blood serum of subjects immunized with a vaccine preparation, e.g. by the performance of an Enzyme Linked Immuno Sorbent Assay (ELISA). Accordingly the present disclosure further comprises a method for evaluating the efficacy of a vaccine preparation comprising a C-lobe domain or N-lobe domain of an HIBP surface receptor protein obtainable from a Gram-negative pathogenic bacterial species wherein the polypeptide is modified in such a manner that it is unable to substantially bind host iron binding protein, the method comprising:

(a) administering to a vertebrate subject a vaccine preparation comprising an HIPB surface receptor protein, or a C-lobe domain or an N-lobe domain of an HIBP surface receptor polypeptide obtainable from a Gram-negative pathogenic bacterial species wherein the polypeptide is modified in such a manner that it is unable to substantially bind host iron binding protein;

(b) obtaining blood serum from the vertebrate subject; and (c) assaying the blood serum for the presence of antibodies against the HIBP surface receptor polypeptides.

The vertebrate blood serum may be assayed following the administration of single or multiple (e.g. 2, 3, or 4) doses of a vaccine preparation. Assays, such as ELISA assays, may be performed using HIBP surface receptor protein isolates from a single or multiple microbial different strains or species. ELISA assays may involve linking of the HIBP surface receptor polypeptide to a carrier protein, such as a maltose binding protein. Where the reactivity of antibodies against multiple HIBP surface receptor protein isolates is assayed, it is possible to evaluate the vaccine preparation for cross-reactivity.

Vaccination Regimens

As is apparent to those skilled in the art in view of the teachings of this specification, vaccination with the above-described polypeptides or with nucleic acid sequences encoding such polypeptides (DNA vaccines) can be effected in one dose, continuously or intermittently throughout the course of treatment. Methods of determining the most effective means and dosages of administration are well known to those of skill in the art and will vary with the delivery vector, the nature of the composition, the specific prophylaxis or therapy sought, the target cells, and the subject being treated. Single and multiple administrations can be carried out with the dose level and pattern being selected by suitable medical personnel.

Administration of the above-described pharmaceutical preparations can be effected in one dose, continuously or intermittently throughout the course of treatment. Delivery will most typically be via conventional needle and syringe for the liquid compositions and for liquid suspensions containing particulate compositions. In addition, various liquid jet injectors are known in the art and may be employed to administer the present compositions. The route of vaccine delivery may vary. Thus the vaccines of the present disclosure may be delivered intravenously, subcutaneous, intramuscular, intravaginal, intraperitoneal, intranasal, oral or via other mucosal routes. Methods of determining the most effective means and dosages of administration are well known to those of skill in the art and will vary with the delivery vehicle, the composition of the therapy, the target cells, and the subject being treated. Single and multiple administrations can be carried out with the dose level and pattern being selected by the attending physician or veterinarian.

EXAMPLES

Below are examples of specific embodiments for carrying out the present disclosure. The examples are offered for illustrative purposes only, and are not intended to limit the scope of the present disclosure in any way.

Example 1—Immune Response with a TbpB C-Lobe Domain, TbpB N-Lobe Domain and Mixture Thereof This Example provides an illustration of the value of using subdomains of the TbpB receptor proteins to obtain a more desirable immune response. In regards to what we mean by a more desirable immune response we consider both the magnitude of the antibody response and the cross-reactivity of the antibodies with variant TbpB proteins.

Figure 3A:
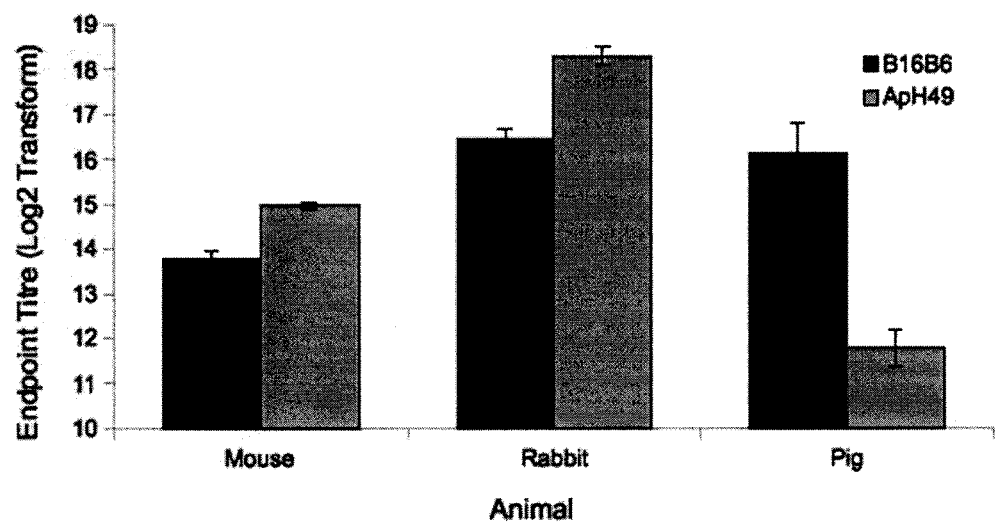
FIG. 3A depicts a comparison of the magnitude of the antibody response against the intact TbpB protein from the human pathogen *Neisseria meningitidis* (strain B16B6—SEQ.ID NO: 117) or the intact TbpB from the porcine pathogen *Actinobacillus pleuropneumoniae* (strain H49—SEQ.ID NO: 2) in different host species (mice, rabbits or pigs) using 33% Emulsigen D as adjuvant. The antibody titre against the TbpB from *Actinobacillus pleuropneumoniae* (grey bar) is slightly higher in mice and rabbits than against the TbpB from *Neisseria meningitidis* (black bar), but substantially lower in pigs. These results infer that binding of host transferrin may be influencing the development of the antibody response.

FIG. 3A illustrates the results from the first experiment for this Example in which different host species (mice, rabbits and pigs) were immunized with intact TbpBs from the human pathogen *Neisseria meningitidis* (strain B16B6—SEQ.ID NO: 117) or from the porcine pathogen *Actinobacillus pleuropneumoniae* (strain H49—SEQ.ID NO: 2). The sera from immunized animals were tested against the immunizing antigen in our customized ELISA assay (see below). The results illustrate that the magnitude (titre) of the antibody response in the pig with the TbpB from the pig pathogen *A. pleuropneumoniae* (grey bar) was substantially lower than in the other host species compared to the TbpB from the human pathogen *N. meningitidis* (black bar) suggesting that binding of host transferrin was influencing development of the antibody response against TbpB.

Figure 3B:
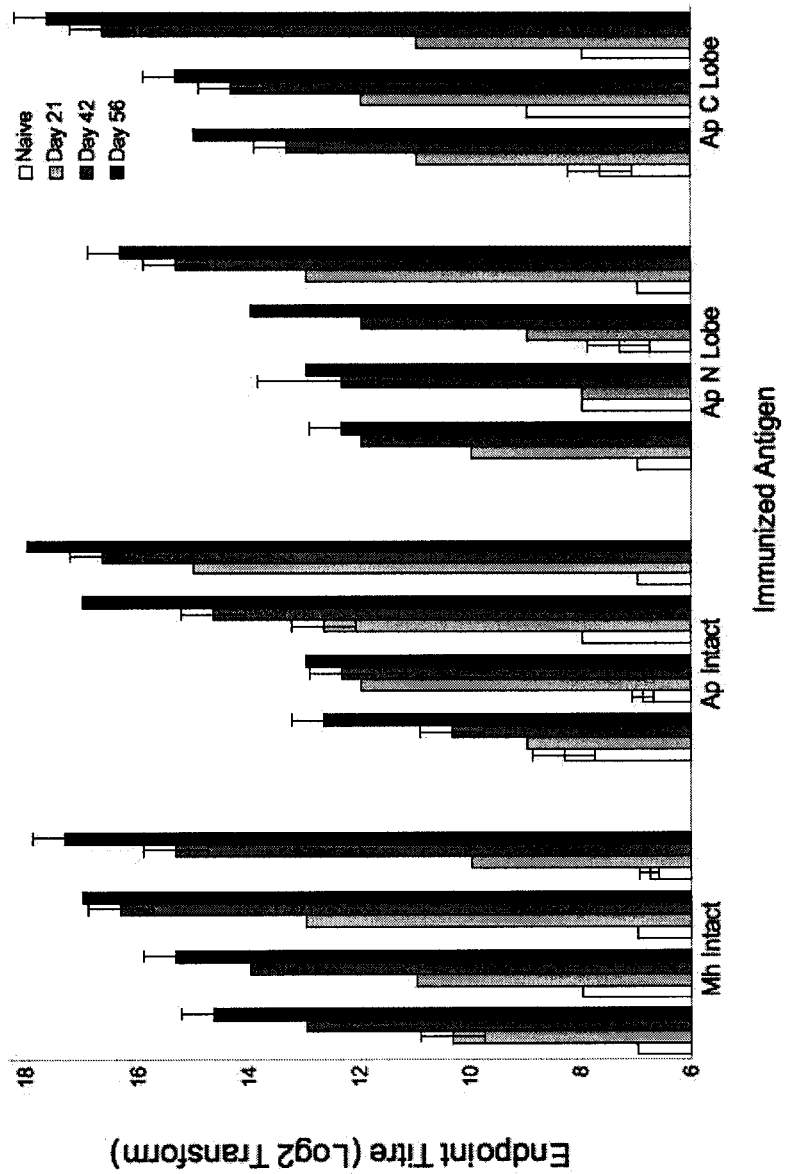
FIG. 3B depicts a comparison of the magnitude of the antibody response in pigs against intact TbpB from the bovine pathogen *Mannhemia haemolytica* (strain H196—SEQ.ID NO: 206) or the intact TbpB (SEQ.ID NO:2), TbpB N-lobe (SEQ.ID NO: 8) or TbpB C-lobe (SEQ.ID NO: 6) from the porcine pathogen *Actinobacillus pleuropneumoniae* (strain H49). The clusters of bars represent serum samples taken from individual pigs immunized on day 0 (prior to the first immunization), day 21 (after the first immunization), day 42 (after the second immunization) and day 56 (after the third immunization). The sera from the pig immunized with intact TbpB from *M. haemolytica* (Mh Intact; strain H196—SEQ.ID NO: 206), were tested with the intact *M. haemolytica* TbpB bound to the ELISA plate. The sera from the pigs immunized with the *A. pleuropneumoniae* TbpB (Ap Intact), TbpB N-lobe (Ap N Lobe) or the TbpB C-lobe (Ap C Lobe) were analyzed with the intact *A. pleuropneumoniae* TbpB bound to the ELISA plate.

The second experiment (FIG. 3B) involves immunization of pigs with intact TbpB from the bovine pathogen *Mannhemia haemolytica* (strain H196—SEQ.ID NO: 206) or the intact TbpB (SEQ.ID NO: 2), TbpB N-lobe (SEQ.ID NO: 8) or TbpB C-lobe (SEQ.ID NO: 6) from the porcine pathogen *Actinobacillus pleuropneumoniae* (strain H49). FIG. 3B illustrates the immune response in individual pigs (cluster of bars) before immunization (white bar), after the first immunization (light grey bar), after the second immunization (dark grey bar) and after the third immunization (black bar). Note that the titres are expressed as a binary logarithm to reflect the two-fold dilutions used in evaluating titre. Most of the pigs displayed high titres of antibody (between 26,000 and 256,000) after the third immunization but several of the pigs immunized with intact TbpB or TbpB N-lobe from *A. pleuropneumoniae* displayed substantially reduced titres (between 5,300 and 8,000). The observation that two of the four pigs immunized with intact TbpB and three of the pigs immunized with TbpB N-lobe displayed substantially reduced titres suggests that binding of host transferrin influences the development of the antibody response only in a subset of the animals.

The third experiment illustrated in this example (FIG. 3C) was designed to evaluate the ability of sera against intact TbpB and its subdomains to react with different representative TbpBs from porcine pathogens in order to evaluate the cross-reactivity of the antisera. Pigs were immunized with the intact TbpB (SEQ.ID NO: 2), the TbpB C-lobe domain (SEQ.ID NO: 6), the TbpB N-lobe domain (SEQ.ID NO: 8) or a mixture of the TbpB N-lobe and TbpB C-lobe. The sera were tested against (i) the intact TbpB from *Actinobacillus pleuropneumoniae* strain H49 (SEQ.ID NO: 2), (ii) the intact TbpB from *Haemophilus parasuis* strain HP5, (SEQ.ID NO: 115) or (iii) the intact TbpB from *Actinobacillus pleuropneumoniae* strain H87 (SEQ.ID NO: 12).

Figure 3C:
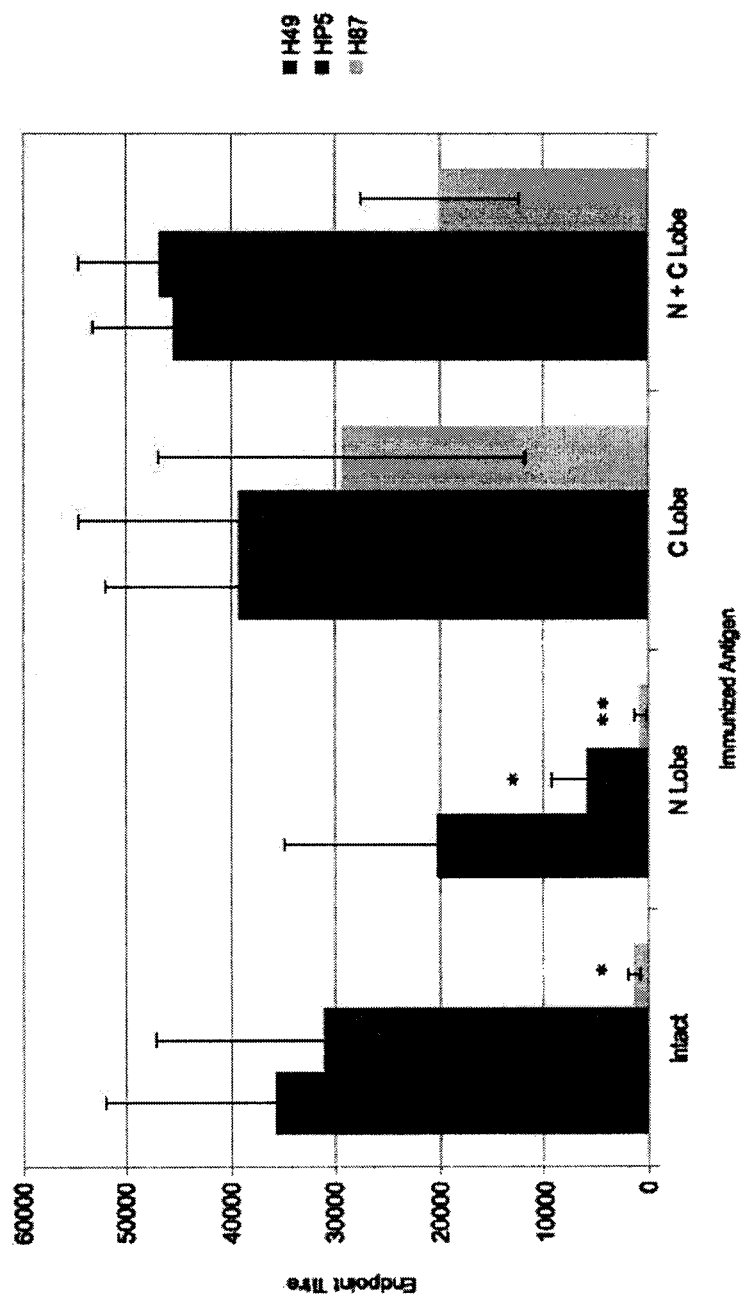
FIG. 3C depicts a comparison of cross-reactivity of antisera against the C-lobe polypeptide domain of TbpB (SEQ.ID NO: 6), N-lobe polypeptide domain of TbpB (SEQ.ID NO: 8) and intact TbpB (SEQ.ID NO: 2) from the porcine pathogen *Actinobacillus pleuropneumoniae* (strain H49). The cluster of bars represent the reactivity of sera against intact TbpB from three different porcine pathogens; *Actinobacillus pleuropneumoniae* strain H49 (SEQ.ID NO: 2, black bar), *Haemophilus parasuis* strain HP5 (SEQ.ID NO: 115, dark grey bar) and *Actinobacillus pleuropneumoniae* strain H87 (SEQ.ID NO: 12, light grey bar) that were selected to represent antigenically diverse TbpBs (FIG. 4). The results illustrate the reactivity of sera immunized with intact TbpB (first cluster from the left, labeled "Intact"), TbpB N-lobe (second cluster from the left, labeled "N lobe"), TbpB C-lobe (third cluster from the left, labeled "C lobe") or a mixture of the N-lobe and the C-lobe (fourth cluster from the left labeled "N+C lobe"). Standard error of the mean (SEM) error bars are shown. The statistics were done via ANOVA with Tukeys HSD (honest significant difference) test done as post hoc. The stars shown on the figure denote specific immunization/protein pairs that differ significantly from the C lobe or N+C lobe tested against H49.
Figure 4:
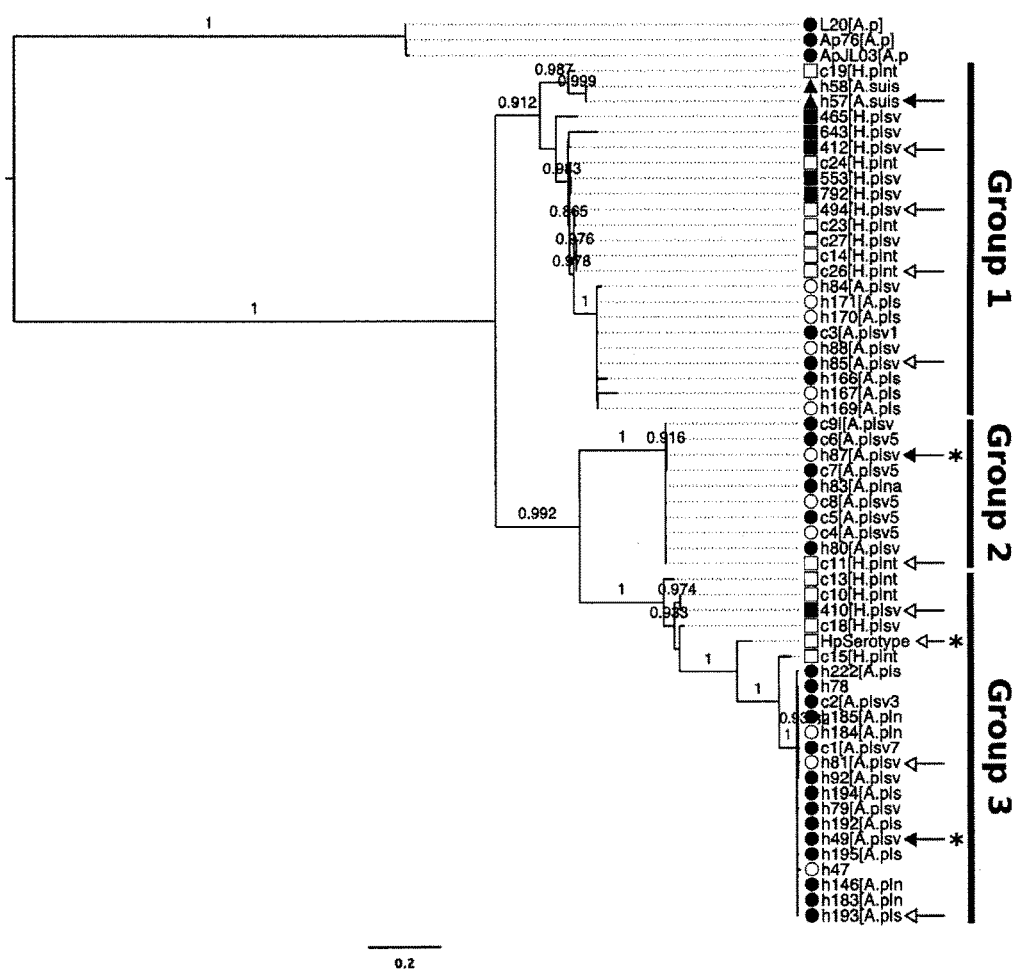
FIG. 4 depicts the sequence diversity of TbpBs from the porcine pathogens *Actinobacillus pleuropneumoniae, A. suis* and *Haemophilus parasuis* isolated from pigs in North America, Europe and Asia. The maximum likelihood phylogenetic tree illustrates the relationship between 56 TbpBs based on sequences from our collection of clinical isolates or obtained from public databases. The TbpB sequences cluster into 3 main groups with representative isolates indicated by the arrows (SEQ.ID NO: 2; SEQ.ID NO: 12; SEQ.ID NO: 28 and SEQ.ID NO: 107 to SEQ.ID NO: 115). The strains that express the TbpB variants used in the ELISA assay illustrated in FIG. 3 are indicated by the large black stars; *A. pleuropneumoniae* strain H87 (SEQ.ID NO: 12), *A. pleuropneumoniae* strain H49 (SEQ.ID NO: 2) and *H. parasuis* strain HP5 (SEQ.ID NO: 115). The large black arrows depict the three TbpBs used in the alignment illustrated in FIG. 1; *A. pleuropneumoniae* strain H87 (SEQ.ID NO: 12), *A. pleuropneumoniae* strain H49 (SEQ.ID NO: 2) and *A. suis* strain H57 (SEQ.ID NO: 28).

The results in FIG. 3C illustrate that the TbpB C-lobe domain from *A. pleuropneumoniae* strain H49 induces a more cross-reactive immune response than the intact TbpB (higher titre against the heterologous TbpB from strain H87)

or the TbpB N-lobe (higher titres against strain H87 and HP5). The TbpBs used in this assay were designed to represent the overall sequence and structural diversity present in clinical disease isolates of *A. pleuropneumoniae, A. suis* and *Haemophilus parasuis* from pigs around the world (SEQ.ID NO: 2; SEQ.ID NO:12; SEQ.ID NO: 28; and SEQ.ID NO: 107 to SEQ.ID NO: 115) (FIG. 4). Thus in this example we are not limiting our analysis to a single pig pathogen but are targeting three distinct pig pathogens that are problematic for the worldwide pig industry. The fact that these pathogens happen to share a common mechanism for acquiring iron from the host provides a unique opportunity to develop a vaccine targeting the three pathogens from a common antigen, TbpB. These results indicate that by using one or more C-lobe domains as an antigen it is feasible to produce a broadly cross-reactive response against pig pathogens worldwide and thus could consider vaccination to eliminate the presence of these pathogens globally.

Surprisingly, the enhanced cross-reactivity induced by the C-lobe domain was retained even when the C-lobe was mixed with the N-lobe in the immunizing mixture (FIG. 3C, "N+C lobe"). These results teach us that antigens with smaller variable loop regions (the "C-lobe" compared to the "N-lobe", FIG. 1) are capable of inducing a more cross-reactive antibody response, and that this enhanced ability to induce a cross-reactive immune response is retained even when the C-lobe is combined with other antigens in the immunizing mixture. More specifically, these results indicate that the tendency for the N-lobe to generate a more strain specific immune response is only capable of effectively inhibiting induction of a cross-reactive immune response by the C-lobe when it is physically linked to the N-lobe. In other words, surprisingly, the propensity of the N-lobe to generate a more specific immune response is substantially reduced when the N-lobe is mixed with the C-lobe. To the best of our knowledge this phenomenon has not been described previously.

The results also suggest that there is a reduced response against the intact TbpB and TbpB N-lobe relative to the C-lobe (FIG. 3B, 3C), which could indicate that binding of host transferrin, a feature only present in the intact TbpB and TbpB N-lobe, may be modulating the immune response in pigs.

It is important to mention that in contrast to previous published studies we did not use the standard ELISA method for measuring antibody levels since we identified a major deficiency in the standard ELISA method. We observed that in contrast to what is commonly assumed, purified proteins do not necessarily bind randomly to the ELISA plates, providing potentially strong biases or deficiencies in evaluating the binding of antibodies to epitopes on the surface of the protein. In particular we noted that TbpB, and particularly the N-lobe of TbpB, essentially binds to the solid surface of ELISA plates in one orientation, masking the Cap region of the N-lobe so that the binding of transferrin cannot be detected (FIG. 5). In contrast, the recombinant fusion protein with an N-terminal maltose binding protein (Mbp) partner that was the precursor for the purified TbpB N-lobe was proficient in transferrin binding (FIG. 5). This phenomenon was observed with TbpB N-lobes from human, pig and cattle pathogens, and to a lesser extent, the intact TbpBs. Since these proteins are quite different in sequence (<30% overall sequence identity) it indicates that this is not a unique property of a specific protein but there may be varying degrees to which nonrandom binding impacts solid-phase binding assays.

To overcome this deficiency we devised a method for binding recombinant proteins to streptavidin-coated ELISA plates by virtue of a biotin residue that was enzymatically added to the N-terminus during protein expression in the cytoplasm. As shown in FIG. 5, the addition of an enzymatically biotinylated N-terminal peptide restored the ability of the TbpB N-lobe to bind transferrin. This approach may be more efficient at exposing the transferrin-binding region as comparison of the results with the Tbp N-lobe fused to Mbp in the left and right side of the figure indicates. This new and novel ELISA assay format was used in all our ELISA assays for monitoring antibody reactivity since it ensured complete and equal access to all epitopes on the target protein, thus providing a true comparison in evaluating the degree of cross-reactivity.

The recombinant antigens for the immunization experiments were produced in the cytoplasm of *E. coli* using a custom T7 expression vector encoding an N-terminal polyhistidine tag, a maltose binding protein and a tobacco etch virus (TEV) protease cleavage site. The recombinant fusion proteins were isolated by Ni-NTA chromatography, the antigens released by (TEV) cleavage and purified by a combination of Ni-NTA and Q-Sepharose chromatography.

FVB mice (albino MHC haplotype H2q from Charles River), 3 month-old New Zealand White rabbits and 51 day-old Large White Landrace F1 cross pigs were used for the immunization experiment in FIG. 3A. Purified recombinant proteins were mixed with phosphate buffered saline and either 33% (FIG. 3A) or 20% (FIG. 3B, FIG. 3C) Emulsigen D (MVP Technologies) to a final concentration of 25 µg in 0.1 ml for mice, 50 µg in 0.5 ml for rabbits and 100 µg in 2 ml for pigs. Three injections were administered sub-cutaneously for mice and rabbits and sub-cutaneously (FIG. 3A) or intramuscularly (FIG. 3B, FIG. 3C) for pigs. The animals were immunized on day 0, 21, 42 and final blood was collected on day 56.

Sera taken at week 8 were tested against representative proteins in our custom solid-phase ELISA assay. The recombinant fusion proteins used in the ELISA assay were produced in the cytoplasm of *E. coli* using a custom T7 expression vector encoding an N-terminal optimized biotinylation sequence, a polyhistidine tag, a maltose binding protein and a tobacco etch virus (TEV) protease cleavage site. These proteins were biotinylated in vivo at the N-terminal biotinylation sequence so that they could be applied to streptavidin coated ELISA plates.

Crude extracts from small-scale overnight protein expression experiments with the expression vector for the biotinylated fusion proteins were sufficient to saturate the ELISA plates based on prior optimization experiments. Dilutions of the antisera of interest were prepared in 2.5% skim milk in phosphate buffer saline (PBST) and applied to the plates for 1 hour at room temperature. After removal and washing the primary antibody was detected by HRP-conjugated goat anti-mouse, anti-rabbit or anti-swine IgG at a dilution of 1:100,000 (1:25,000 for anti-swine) for one hour at room temperature. The titre is expressed as the reciprocal of the last dilution with an A450>0.3 (greater than the mean plus three standard deviations of the background reading of wells without sera added).

The calculation of SEM error was done via ANOVA with Tukeys HSD (honest significant difference) test done as post hoc. The statistics showed that for all the sera, H49 is significantly different from H87 and that the N lobe is significantly different from the C lobe or the N+C lobe. The stars shown in FIG. 3C denote specific immunization/protein pairs that differ significantly from the C lobe or N+C lobe tested against H49.

Example 2—Production of a Trimer of Porcine Pathogen TbpB C-Lobes

Figure 6:
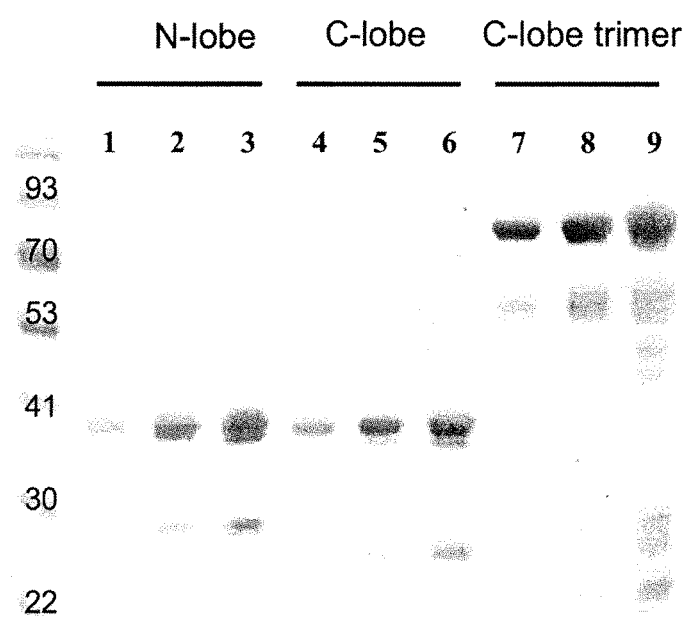
FIG. 6 depicts the design and production of a multimer comprised of the TbpB C-lobe from three different porcine pathogens. Panel A shows the DNA and protein sequence for the trimer (SEQ.ID NO: 39; SEQ.ID NO: 40) of C-lobes from *A. pleuropneumoniae* strain H49 (SEQ.ID NO: 6), *A. suis* strain H57 (SEQ.ID NO: 35) and *A. pleuropneumoniae* strain H87 (SEQ.ID NO: 22), in that order. The underline indicates the peptide sequence connecting the individual C-lobes or preceding the first C-lobe. Panel B illustrates SDS-PAGE analysis of a preparation of the C-lobe trimer compared to preparations of the N-lobe and C-lobe from *N. meningitidis* strain M982. 1 μl of sample was applied to lanes 1, 4 & 7, 5 μls to lanes 2, 5 & 8 and 10 μls to lanes 3, 6 & 9. Protein molecular weight standards (MWS) observed on these gels are 93, 70, 63, 41, 30 and 22.

In this Example we demonstrate that three recombinant engineered C-lobes that represent a wide diversity of TbpBs present in the three porcine pathogens, may be linked together and retain antigenicity. The engineered C-lobes used here are those obtained from *A. pleuropneumoniae, A. suis* and *Haemophilus parasuis* (FIG. 4). Thus the genes encoding the TbpB C-lobes from strains *A. pleuropneumoniae* H49 (SEQ.ID NO: 6), *A. suis* H57 (SEQ.ID NO: 35) and *A. pleuropneumoniae* H87 (SEQ.ID NO: 22) were linked to form a gene encoding a single polypeptide encompassing the three C-lobes (SEQ.ID NO: 40) Panel A of FIG. 6. There are relatively short peptides connecting the secondary structural elements of the C-lobes (indicated by underline) in this C-lobe trimer. The linking peptides consist of authentic interlobe sequence from the individual C-lobe domains. Panel B of FIG. 6 illustrates the production of the C-lobe trimer and is compared to preparations of recombinant engineered TbpB N-lobe and C-lobe from the human pathogen *N. meningitidis* strain M982. The results indicate that the C-lobe trimer is produced in good quantity and is stable. However the preparation illustrated in FIG. 6 requires additional purification prior to use in immunization experiments.

Figure 7:
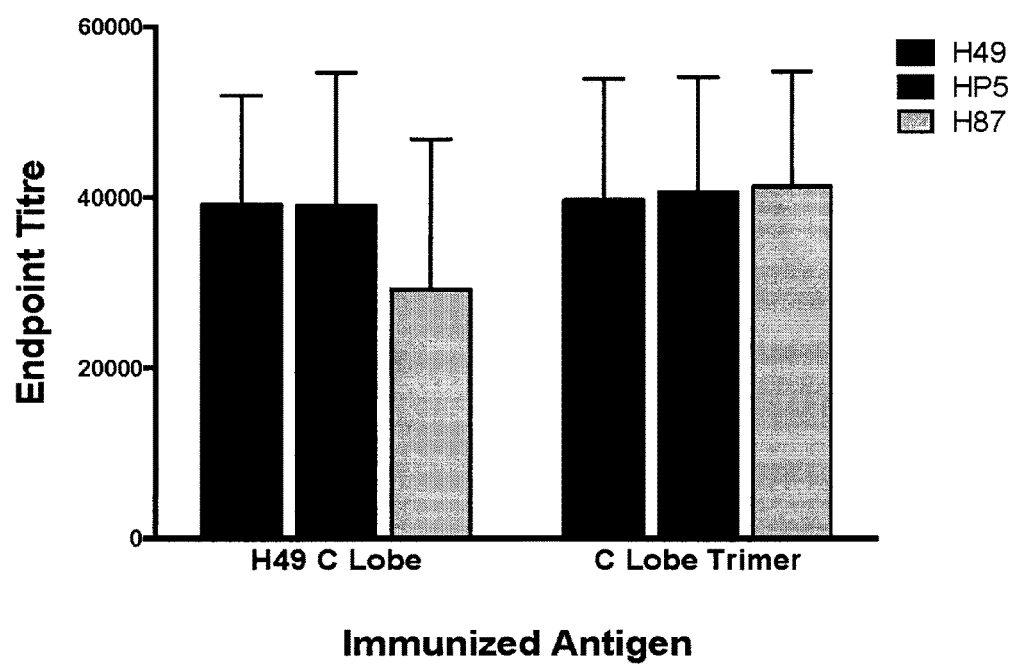
FIG. 7 depicts the immune response against the TbpB C-lobe from *A. pleuropneumoniae* (H49 C-lobe, SEQ.ID NO: 6) compared the immune response against a trimer comprised of C-lobes from TbpB C-lobes from *A. pleuropneumoniae* H49, *A. suis* H57 and *A. pleuropneumoniae* H87 (C-lobe trimer, SEQ.ID NO: 40). The cluster of bars on the left side of the figure represent the immune response against H49 C-lobe whereas the cluster of bars on the left side of the figure represents the immune response against the C-lobe trimer. The black bar represents the immune response against the TbpB from *A. pleuropneumoniae* strain H49 (SEQ.ID NO: 2), the dark grey bar represents the immune response against the TbpB from *H. parasuis* strain HP5 (SEQ.ID NO: 115) and the light grey bar represents the immune response against the TbpB from *A. pleuropneumoniae* strain H87 (SEQ.ID NO: 22).

Since there was no major barrier to the production of a stable C-lobe trimer, the C-lobe trimer was produced and purified for an immunization experiment to determine whether it retained immunogenicity. As illustrated in FIG. 7, the C-lobe trimer was able to induce an immune response against the three representative TbpBs, indicating that linking the three individual C-lobes together did not substantially alter their immunological properties. The results also suggest that a single protein antigen may be able to induce an immune response capable of reacting with most, if not all strains of the *pleuropneumoniae, A. suis* and *Haemophilus parasuis*, pig pathogens, showing potential promise for development of a broadly cross-protective pig vaccine.

Example 3—Reduction of Loop Regions in the N-Lobe of *A. pleuropneumoniae* TbpB

In this Example, the loop regions of the N-lobe domain from three representative TbpBs from porcine pathogens were modified in order to determine their impact on induction of a cross-reactive immune response. The three representative TbpBs were from *A. suis* strain H57 (SEQ.ID NO: 28), *A. pleuropneumoniae* strain H87 (SEQ.ID NO: 12) and *A. pleuropneumoniae* strain H49 (SEQ.ID NO: 2). These particular TbpBs were selected because in addition to representing sequence diversity, there was high-resolution structural data available; A, suis strain H57 (3PQU.pdb), *A. pleuropneumoniae* strain H87 (3PQS.pdb) and *A. pleuropneumoniae* strain H49 (3HOL.pdb). The loop reduction process resulted in an overall loss of 74 amino acids (297-224) for the TbpB N-lobe from *A. suis* strain H57 (SEQ.ID NO: 36,38), 45 amino acids (248-203) for the TbpB N-lobe from *A. pleuropneumoniae* strain H87 (SEQ.ID NO: 24,26) and 27 amino acids (274-247) for the TbpB N-lobe from the *A. pleuropneumoniae* strain H49 (SEQ.ID NO: 8,10). The design of the loop reduction for *A. pleuropneumoniae* strain H49 is described in more detail below for illustrative purposes.

To design the loop reductions, the structure of TbpB from strain H49 (3HOL.pdb) was superimposed with the structure of TbpB from strain H87 (3PQS.pdb) while simultaneously viewing a multiple sequence alignment from a set of representative TbpBs from porcine pathogens. By examining the structure and regions of variation, several areas for potential loop reduction were identified that were predicted to not perturb the overall structure of the N-lobe. These include loops 1, 5, 8a, 8c and 12 according to the standard nomenclature (FIG. 2) and are illustrated in FIG. 8 on structural models of a side view (Panel A) and top view (Panel B) of the TbpB N-lobe. Loop reductions were designed to minimize the potential perturbation to the overall folding and structure of the N-lobe by selecting appropriate amino acid replacements as needed in addition to the removal of amino acids. The amino acid sequence of the original N-lobe (top sequence) and the modified N-lobe (bottom sequence) are illustrated in the sequence alignment in FIG. 8, Panel C where the loop regions are highlighted in grey and labeled in grey font. The DNA sequence encoding the amino acid sequence illustrated in Panel C was optimized for expression in *E. coli* strain and then synthesized.

A similar strategy was adopted to generate loop reductions for the TbpB N-lobes from *A. pleuropneumoniae* strain H87 and *A. suis* strain H57 since they represent considerable sequence and structural diversity of the TbpBs from porcine pathogens (FIG. 4) and the relevant structures are available (3PQS.pdb and 3PQU.pdb) (12). The potential of producing engineered antigens that collectively could induce a cross-reactive response against the N-lobe regions of most if not all, clinical isolates, would have considerable potential for enhancing the effectiveness of a vaccine targeting the three porcine pathogens.

The resulting genes were cloned into a custom expression vector that encodes an N-terminal polyhistidine region, maltose binding protein and TEV (tobacco etch virus) cleavage site preceding the coding sequence for the cloned N-lobe. The expression plasmid for the engineered version of the TbpB N-lobe from *A. pleuropneumoniae* strain H49 was transformed into the *E. coli* expression strain ER256 that carries a chromosomal copy of the T7 RNA polymerase gene inserted downstream of the lacZ promoter. A small-scale expression analysis was performed using auto-induction media (55) that capitalizes on glucose repression and lactose induction of the lac promoter. Thus by using a specific ratio of glucose to lactose into the media, expression of the T7 RNA polymerase is optimally initiated at mid-log phase of growth. Cells were lysed after overnight growth with a bead beater to lyse the cells, the recombinant proteins were captured with either a Ni-NTA resin or a porcine Tf-Sepharose resin, washed and the bound proteins eluted in SDS-PAGE buffer.

Figure 9:
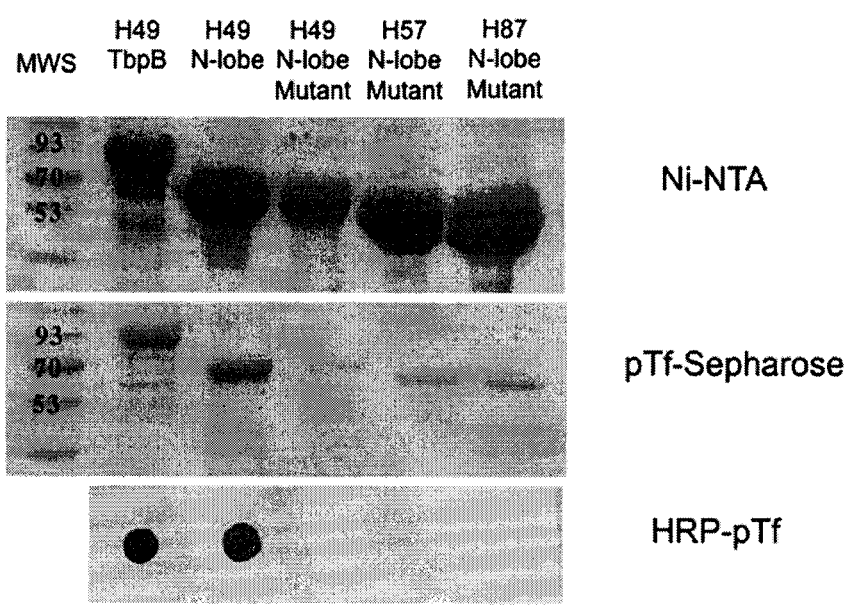
FIG. 9 illustrates that the engineered loop reduction of the TbpB N-lobes from *A. pleuropneumoniae* strain H49 (SEQ.ID NO: 10), *A. suis* strain H57 (SEQ.ID NO: 38) and *A. pleuropneumoniae* strain H87 (SEQ.ID NO: 26) did not adversely affect their production or stability but eliminated binding by porcine Tf. The upper panel illustrates the production of intact H49 TbpB (SEQ.ID NO: 2), native h49 TbpB N-lobe (SEQ.ID NO: 8) and the engineered TbpB N-lobes from *A. pleuropneumoniae* strain H49 (SEQ.ID NO: 10), *A. suis* strain H57 (SEQ.ID NO: 38) or *A. pleuropneumoniae* strain H87 (SEQ.ID NO:26). They were expressed as fusion proteins with an N-terminal maltose binding protein with a polyhistidine tag and captured on a Ni-NTA resin. The bound proteins were released in SDS-PAGE buffer and analyzed on a 10% SDS-PAGE gel. The middle panel represents the same preparations captured with an affinity resin consisting of porcine transferrin coupled to Sepharose (pTf-Sepharose) and eluted in SDS-PAGE buffer. The bottom panel illustrates a dot assay with the material from the upper panel eluted from the Ni-NTA resin and spotted onto a nitrocellulose resin, blocked and exposed to horse-radish peroxidase conjugated porcine transferrin (HRP-pTf) in blocking solution, and the bound HRP detected with incubation in HRP substrate.

As illustrated in FIG. 9 the loop reductions in the TbpB N-lobe from *A. pleuropneumoniae* strain H49, *A. suis* strain H57 or *A. pleuropneumoniae* strain H87 resulted in the production of stable proteins, thus not interfering with the overall folding of the N-lobe, and providing material suitable for immunization. The upper panel shows recombinant proteins produced in a small-scale expression experiment captured on a Ni-NTA resin with the wild-type intact TbpB and TbpB N-lobe as controls. The results also show, that unlike that wild-type protein, the mutant proteins were no longer capable of substantially binding to porcine transferrin (Tf). Thus in the middle panel the engineered N-lobes were not captured by porcine Tf-Sepharose. In the bottom panel the material illustrated in the top panel was used in a solid-phase binding assay using HRP-conjugated porcine transferrin and, unlike the controls, the engineered N-lobes did not display any binding activity. We anticipate that there will be enhanced immunogenicity of these proteins in the native host, pigs. Thus this example shows that strategies for removal of antigenically variable regions in the N-lobe of TbpB proteins are feasible and that such removal can result in enhanced immunogenicity.

Example 4—Cross-Reactivity of C-Lobes of *N. meningitidis* TbpB

This example illustrates the use of engineered derivatives of TbpBs from the human pathogen *Neisseria meningitidis* in accordance with the present disclosure. As a first step we examined the diversity of TbpBs from *N. meningitidis* and ensured that we would have a representative set of TbpBs for our evaluation of cross-reactivity. FIG. 10 illustrates the overall diversity of TbpBs in strains of *N. meningitidis* that were collected globally over a long time period plus additional sequences from the *Neisseria* Bacterial Isolate Genome Sequence Database (BIGSDB) (pubmlst.org/neisseria/)(56) (41). The sequences for a representative set of TbpBs (SEQ ID NO: 117; SEQ.ID NO: 123; SEQ.ID NO: 132 to SEQ.ID NO: 147; SEQ.ID NO: 177; and SEQ.ID NO: 178) from strains indicated by arrows, double arrows or lines in FIG. 10A are included in this application to define the sequence diversity in each group. There were four major phylogenetic groupings of the *N. meningitidis* TbpBs. Group 1 includes strains that possess isotype I TbpBs. Isotype I TbpBs characteristically have smaller TbpBs (approximately 65-70 kDa) compared to the isotype II TbpBs (80-85 kDa). Comparison of the sequences by multiple sequence alignments revealed that difference in size is largely attributed to the C-lobe being larger in isotype II TbpBs. The isotype II TbpBs clustered into three major phylogenetic groups (Groups 2-4, FIG. 10A).

A phylogenetic tree illustrating the sequence diversity of the TbpB C-lobes (FIG. 10B) supports the conclusion that the C-lobe sequences are largely responsible for the identification of the two TbpB isotypes. The members of Group 2 in FIG. 10A do not cluster together in the C-lobe phylogenetic tree but are distributed throughout the tree in FIG. 10B, indicating that Group 2 was largely defined by the N-lobe sequences. This indicates that if immunological cross-reactivity is going to be determined by reactivity against the C-lobe, specific representatives of group 2 would not be required. In contrast, the arrows and lines that were used to identify a set of TbpB sequences to represent the overall TbpB diversity did not adequately represent the overall C-lobe diversity, thus two additional strains were selected to provide a more comprehensive representation of the C-lobe diversity. The C-lobe sequences from strains identified by the arrows, double arrows or lines are included in this application to provide a representative sample of the sequence diversity (SEQ ID NO: 87; SEQ.ID NO: 93; and SEQ.ID NO: 147 to SEQ.ID NO: 163).

Figure 26A:
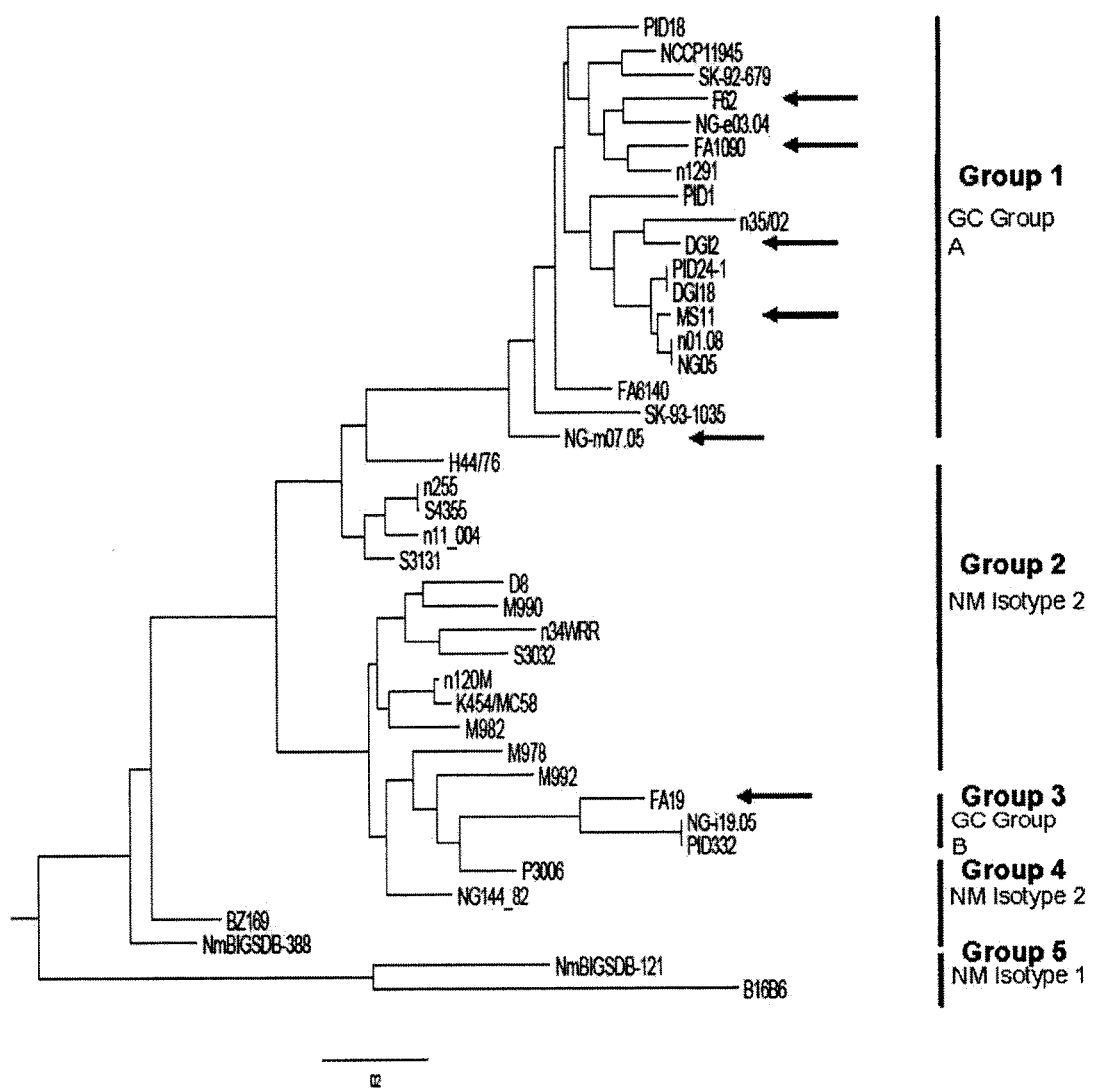
Figure 26B:
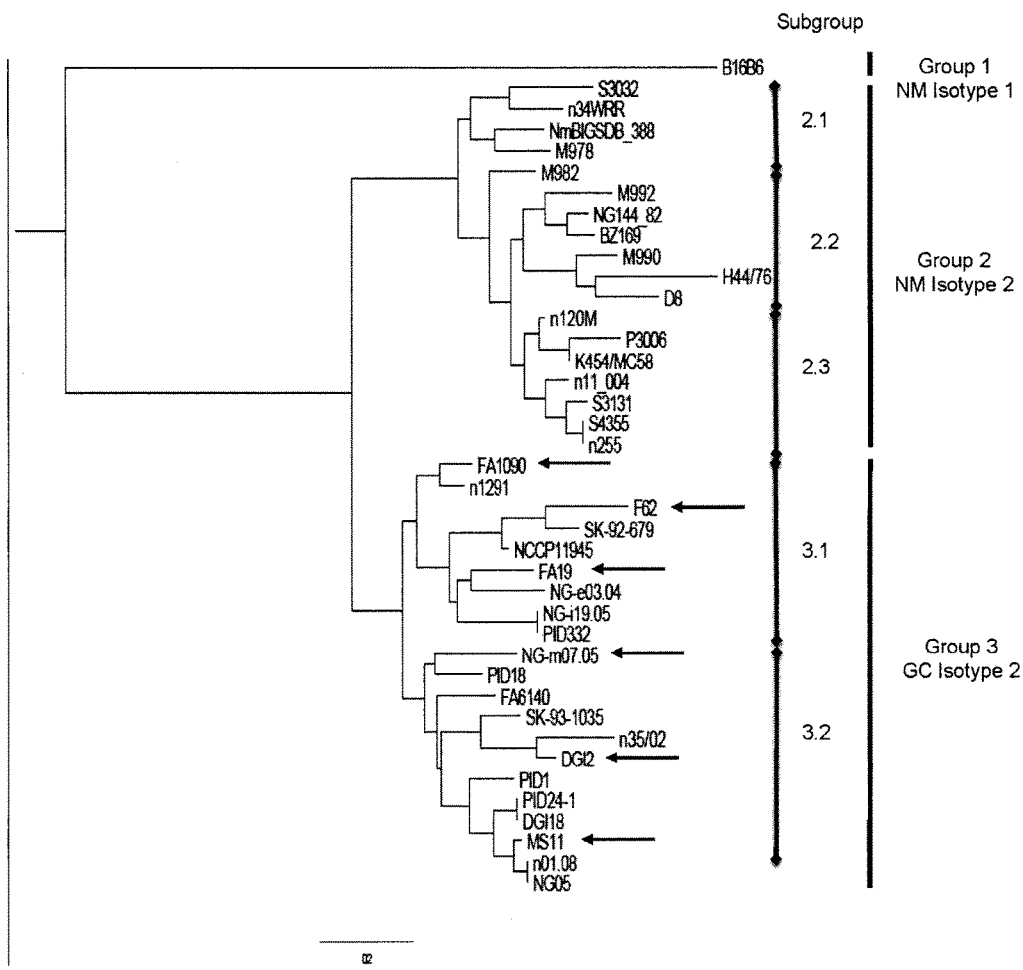

In order to address the question as to whether a vaccine targeting the TbpB from *N. meningitidis* might induce an immune response directed against *gonorrhoeae* we performed an analysis of the sequence diversity of the TbpB and TbpB C-lobes from *N. gonorrhoeae*. The sequences of the representative TbpBs and TbpB C-lobes from the *N. meningitidis* study (FIG. 10; SEQ.ID NO: 119; SEQ.ID NO: 125; SEQ.ID NO: 179 to SEQ.ID NO: 195; SEQ.ID NO: 117; SEQ.ID NO: 123; SEQ.ID NO: 132 to SEQ.ID NO: 147; SEQ.ID NO: 177; and SEQ.ID NO: 178) were included in the analysis. As illustrated in FIG. 26A, the *N. gonorrhoeae* TbpBs are most closely related to the isotype 2 TbpBs and form two subgroups within the *N. meningitidis* isotype 2 cluster. This suggests that with strategies using site-directed mutants of recombinant TbpB as preferred vaccine antigens, it might be possible to achieve broad cross-protection primarily with antigens derived from meningococcal TbpBs. FIG. 26B illustrates that, in contrast to the situation with the intact TbpBs, the *N. gonorrhoeae* TbpB C-lobes are a distinct subgroup from the *N. meningitidis* C-lobes. Thus with strategies using C-lobes to provide broad cross-protection, C-lobes from *N. gonorrhoeae* strains would be required.

In order to compare the ability of the truncated TbpB and the TbpB C-lobe to induce a cross-reactive antibody response, a recombinant truncated TbpB and a TbpB C-lobe derived from *N. meningitidis* strain, B16B6 (marked by black arrow in FIG. 10), were selected for the immunological analysis. A recombinant truncated TbpB and a TbpB C-lobe from strain B16B6 were used to immunize rabbits and the sera was tested for cross-reactivity using our novel ELISA assay (FIG. 5). It is important to recognize that many of the sequences of the C-lobes included in this application start just after the end of the last beta-strand of the barrel domain on the N-lobe, thus include the linker region between the N-lobe and C-lobe (L15, FIG. 2). Thus it would be possible to prepare stable, functional C-lobes with N-terminal truncations that remove the L15 region (14 amino acids in the B16B6 C-lobe) for immunization experiments.

A representative set of TbpBs derived from strains distributed throughout the phylogenetic tree (black and grey arrows, FIG. 10) were selected to evaluate the cross-reactivity of the sera. Two additional TbpBs indicated by the two double-headed arrows would have been included in the analysis to provide more complete coverage, but were not available at the time of the analysis.

The proteins were expressed in our custom expression vector with an N-terminal biotinylation sequence, and were applied to streptavidin coated ELISA plates. The sera from rabbits immunized with the engineered C-lobe and truncated TbpB derived from strain B16B6 were tested for their ability to recognize the panel of TbpB variants. The antiserum against the truncated TbpB had higher titres against the homologous TbpB (B16B6) than the anti-C-lobe antiserum, and slightly higher or equivalent titres against the TbpB from one of the heterologous strains (H44/76). However, the anti-C-lobe antiserum had higher titres of antibody against TbpBs from all of the other heterologous strains than that anti-TbpB antiserum. Thus the C-lobe is superior in its ability to induce cross-reactive antibodies than the intact TbpB.

In this immunization experiment the recombinant antigens were produced as described above and used to immunize rabbits (New Zealand White, 3 months old, female) sub-cutaneously in the hind region using 50 µg of purified antigen in 20% Emulsigen D (VSA) adjuvant. The rabbits were immunized at 0, 3 and 6 weeks.

Sera taken at week 8 were tested against representative proteins in our custom solid-phase ELISA assay. The recombinant fusion proteins used in the ELISA assay were produced as described above. The recombinant proteins tested in the custom ELISA assay were truncated versions of the intact TbpBs (missing the first 19-36 amino acids) from *N. meningitidis* strains; (i) B16B6 (SEQ ID NO: 117), (ii) H44/76 (SEQ.ID NO: 133), (iii) S3131 (SEQ.ID NO:132), (iv) M990 (SEQ.ID NO:134), (v) M978 (SEQ.ID NO:135), (vi) M992 (SEQ.ID NO:138), (vii) P3006 (SEQ.ID NO:139), (viii) 120M (SEQ.ID NO:137), (ix) MC58 (SEQ.ID NO:136) and (x) M982 (SEQ.ID NO: 123).

Crude extracts from small-scale overnight protein expression experiments with the expression vector for the biotinylated fusion proteins were sufficient to saturate the ELISA plates based on prior optimization experiments. Dilutions of the antisera of interest were prepared in 2.5% skim milk in phosphate buffer saline (PBST) and applied to the plates for 1 hour at room temperature. The primary antibody was detected by HRP-conjugated goat anti-rabbit IgG at a dilution of 1:100,000 for one hour at room temperature and the titre is expressed as the reciprocal of the last dilution with an A450>0.3.

Example 5—Production of a Dimer of *N. meningitidis* TbpB C-Lobes

Figure 11:
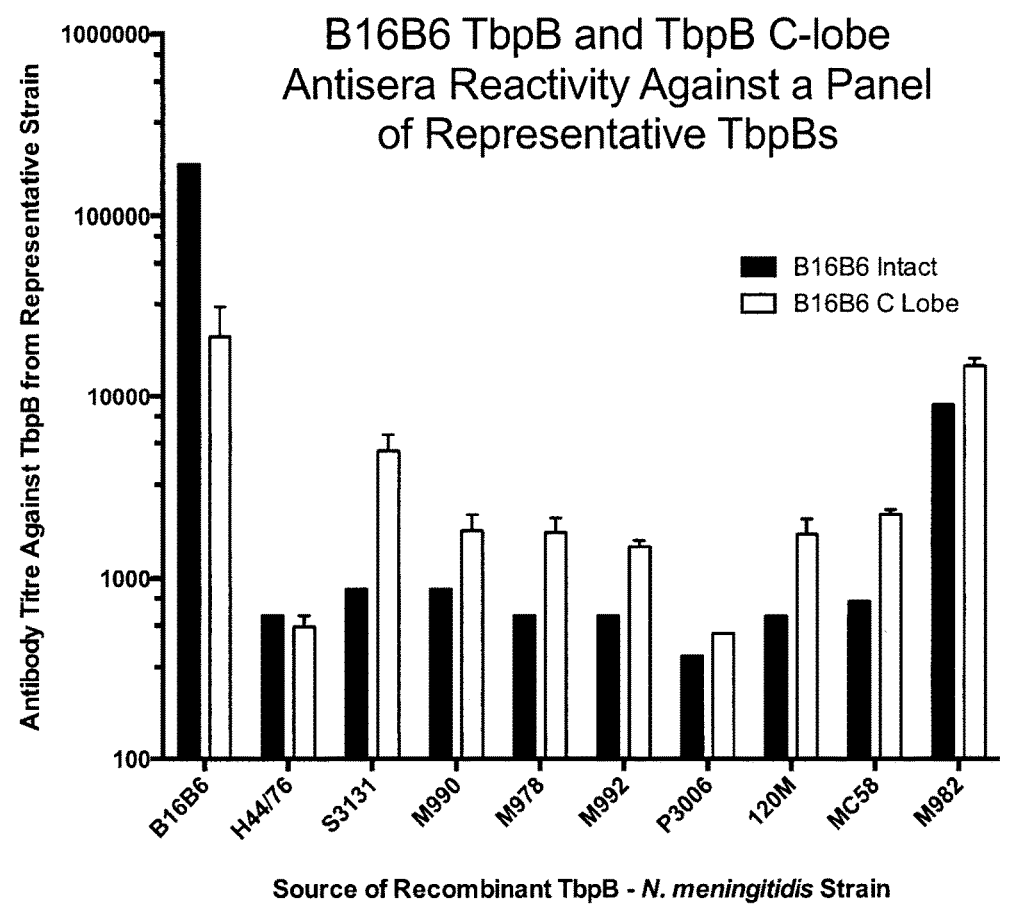

The result in FIG. 11 illustrates that the TbpB C-lobe domain from the human pathogen *N. meningitidis* is capable of inducing an enhanced cross-reactive response relative to the intact TbpB. In this example we demonstrate that it is possible to generate a single polypeptide encompassing the two C-lobes that is stable and immunogenic. The two C-lobes are from strains with antigenically divergent TbpBs, strain B16B6 and M982, that represent the two isotypes of TbpB (FIG. 10). Panel A of FIG. 12 illustrates a single gene that was constructed to encode the two representative TbpB C-lobes (SEQ.ID NO: 150) used in the immunization experiments described in Example 4. Panel B of FIG. 12 illustrates the production of the C-lobe dimer compared to preparations of the individual constituent TbpB C-lobes. There are reasonable levels of production of the C-lobe dimer that appears to be relatively stable but additional purification would be required prior to use in immunization experiments.

FIG. 13 illustrates that the dimer consisting of the TbpB C-lobes from *N. meningitidis* strains M982 and B16B6 is capable of inducing an effective immune response against intact TbpBs from both species.

Example 6—Reduction of Loop Regions from the C-Lobe of *N. meningitidis*

In this Example we demonstrate it is possible to substantially reduce the loop regions from the C-lobe of *N. meningitidis*. Such reduction is useful in that it provides a derivative lacking the large loop regions which may be used as a convenient ‘scaffold’ for displaying epitopes from other antigens or other pathogens, and further may display desirable immunological properties.

In this example the loop regions of the C-lobe domain from *N. meningitidis* strain M982 were modified to remove a total of 82 amino acids from the large, flexible loop regions. Structural models of the native C-lobe and the engineered C-lobe with substantial reduction of four of the large flexible loops are illustrated in Panel A of FIG. 14. The four loops targeted for reduction were not resolved in the protein crystallography based structure (3VE2.pdb), indicating that there was variation in the conformation of the loops, which is why the loops are represented by dotted lines in model on the left in Panel A.

The strategy for loop removal was developed by examination of the detailed structure (3VE2.pdb) while evaluating the sequence variability in sequence alignments of selected C-lobes. However, providing the most effective bridge between the loops without potentially disrupting the structure was a dominant criteria for the selection of bridging amino acids. The alignment of sequences of the native C-lobe (SEQ.ID NO: 125), engineered derivatives lacking each of the targeted loops and a ‘loopless’ C-lobe with all four loops removed (SEQ.ID NO: 129) is illustrated in Panel 13 of FIG. 14.

Using the splicing by overlap extension approach (SOEing) (57) genes encoding the individual loop deletions and the ‘loopless’ C-lobe with all four loops removed were prepared. The SOEing approach was performed on the expression plasmid used for production of the recombinant C-lobe from *N. meningitidis* M982, so that the stability of the resulting engineered proteins could readily be evaluated. The vector encodes an N-terminal polyhistidine tag, the gene encoding maltose binding protein and a TEV (tobacco etch virus) cleavage site preceding the inserted gene encoding the TbpB C-lobe. The expression plasmid was transformed into the *E. coli* expression strain ER2566 that carries a chromosomal copy of the T7 RNA polymerase gene inserted into the lacZ gene, and thus is under the control of the lac promoter. A small-scale expression analysis was performed using auto-induction media (55). After overnight growth the cells were collected and lysed and the supernatant fraction after centrifugation was applied to a Ni-NTA resin, washed and the bound proteins eluted in SDS-PAGE buffer.

As illustrated in FIG. 15, the yields of the recombinant C-lobes with substantial reductions in loop 18, loop 21, loop 23 or loop 27 were comparable to the native C-lobe protein (WT), indicating that the removal of the individual loops did not adversely effect protein stability. FIG. 15 also shows that the removal of 81 amino acids in all four loops did not impact the level of protein produced, indicating that the removal of all four loops did not interfere with the overall folding of the C-lobe. It is salient to mention that the ‘loopless’ C-lobe was readily produced and purified in good quantity, and that the crystal structure has been obtained from the purified ‘loopless’ C-lobe. This indicates that the engineered antigens can readily be produced in a substantially stable form at levels of production that are suitable for commercial applications. Thus this example not only shows that strategies for removal of antigenically variable regions are feasible, but that the resulting protein may be suitable as an epitope display scaffold since the folding of the core structure is not influenced by variations in the size and nature of the loops.

Finally, as illustrated in FIG. 16, the ‘loopless’ C-lobe (SEQ.ID NO: 129, last two bars) is immunogenic and capable of inducing a strong antibody response against the intact (native) TbpB antigen (SEQ.ID NO: 123). This figure illustrates that the loopless C-lobe actually induced higher titers of antibody against the TbpB from *N. meningitidis* strain M982 in mice than the original TbpB C-lobe (SEQ ID NO: 125) antigen (compare 3$^{rd}$ and 1$^{st}$ bars in the figure). Just as surprising is the observation that the ‘loopless’ C-lobe induced similar levels of antibodies against the heterologous TbpB from strain B16B6 as the native TbpB C-lobe from B16B6, in spite of the fact that it is quite divergent in sequence (FIG. 10). Comparison of the 2$^{nd}$ and 4$^{th}$ bars in FIG. 16 illustrate that these two proteins induce a similar level of antibodies against intact TbpB from strain B16B6.

In these experiments FvB female mice were immunized with 25 ug of purified protein antigen with 20% emulsigen D on day 0, 21 and 42 and sera taken at day 56 were assessed for endpoint titre using our custom ELISA assay. The B16B6

TbpB C lobe, M982 TbpB C lobe, or modified M982 TbpB ('loopless') were used to immunized four mice each. Endpoint titres were assessed against biotinylated intact M982 or B16B6 TbpB protein. Titres were determined with 1:100,000 of goat anti-mouse IgG H+L peroxidase conjugated antibody. Endpoint titres were determined as the inverse of the last dilution at which a positive signal could be confidently detected. Each serum was run in triplicate and results are shown as the average of all mice with that treatment+/−SEM.

Example 7—Insertion of Portions of TbpA into an Engineered C-Lobe of a TbpB

In this example, the DNA encoding segments of the extracellular surface loops of the integral outer membrane protein transferrin binding protein A, TbpA, were spliced into the gene encoding the modified or 'loopless' TbpB C-lobe from *N. meningitidis* strain M982, resulting in genes encoding various hybrid TbpA-TbpB proteins. The reason for splicing selected regions of TbpA onto the TbpB C-lobe scaffold is that it provides a more efficient means of production than the intact TbpA protein, and provides the ability to specifically target surface regions of TbpA for induction of antibody.

The gene encoding the modified C-lobe of the TbpB polypeptide (SEQ ID NO: 97) prepared in Example 6 was used as a starting point (see further: Panel A of FIG. 14 (middle model). The DNA encoding segments from different surface loops of TbpA (FIG. 17, Panel A) were spliced into the sites where the larger loops had been removed from the TbpB C-lobe polypeptide (FIG. 17, Panel B). Portions from the beta-barrel extracellular loops 3, 10, and 11 of TbpA (58) (space filled and labeled regions in Panel A) were inserted into the modified loop regions 18, 21 and 23 of the engineered TbpB C-lobe (Panel B). Similarly, a segment from the N-terminal plug region that inserts between the C1 and C2 domains of human transferrin in the TbpA-transferrin structure (plug loop, Panel A) was inserted into the modified loop 27 of the modified TbpB C-lobe.

Assembly of the TbpA loops on the TbpB C-lobe was done using the splicing by overlap extension approach (SOEing) (57). The SOEing approach was performed on the expression plasmid used for production of the recombinant C-lobe from *N. meningitidis* M982, so that the stability of the resulting engineered proteins could readily be evaluated. The vector encodes an N-terminal polyhistidine tag, the gene encoding maltose binding protein and a TEV (tobacco etch virus) cleavage site preceding the inserted gene encoding the TbpB C-lobe. The expression plasmids were transformed into the *E. coli* expression strain ER2566 that carries a chromosomal copy of the T7 RNA polymerase gene inserted into the lacZ gene, and thus is under the control of the lac promoter. A small-scale expression analysis was performed using autoinduction media (55). After overnight growth the cells were collected and lysed and the supernatant fraction after centrifugation was applied to a Ni-NTA resin, washed and the bound proteins eluted in SDS-PAGE buffer.

As illustrated in Panel A of FIG. 18, insertion of the foreign TbpA segments into the loops of the modified TbpB C-lobe resulted in the production of stable recombinant protein. The recombinant proteins illustrated in Panel A of FIG. 18 contained an N-terminal polyhistidine tag, a maltose-binding protein fusion partner and a TEV (tobacco etch virus) protease cleavage site. Panel B of FIG. 18 illustrates the release of the wild-type and mutant C-lobes from the recombinant protein fusion partner by cleavage with TEV protease. The results demonstrate that insertion of the foreign protein segments did not substantially affect the stability of the engineered C-lobe, suggesting that the foreign segments did not interfere with the normal folding of the core structural elements of the C-lobe. The implication of these results is that the C-lobe appears to be a stable and versatile protein scaffold for the display of foreign epitopes that could ultimately be used for display of epitopes from a variety of antigens and antigenic variants, providing an additional strategy for generating engineered antigens with the ability to generate a broadly cross-protective immune response.

Finally, as illustrated in FIG. 19, modified TbpB C-lobes containing regions of TbpA spliced into the regions where large loops were reduced or removed are immunogenic. This figure illustrates that hybrid TbpA-TbpB C-lobe proteins induced antibody titres equal to or higher than the parent modified ('loopless') C-lobe. Notably the proteins displaying regions from loop 10 and loop 11 from TbpA had the highest titres ($2^{nd}$ and $3^{rd}$ bars in FIG. 19).

In this experiment, FvB female mice were immunized with 25 µg of purified protein antigen with 20% emulisgen D on day 0, 21 and 42 and sera taken at day 56 was assessed for endpoint titre using our custom ELISA assay. Three mice were immunized the 'loopless' C-lobe with all four loops removed (SEQ.ID NO: 97). Five mice were used for immunization with the each of the four other hybrid antigens; (i) the 'loopless' C-lobe with TbpA loop 10 inserted into the TbpB C-lobe loop 21 (SEQ.ID NO: 154), (ii) the 'loopless' C-lobe with TbpA loop 11 inserted into the TbpB C-lobe loop 23 (SEQ.ID NO: 156), (iii) the 'loopless' C-lobe with TbpA loop 3 helix inserted into the TbpB C-lobe loop 27 (SEQ.ID NO: 158), or (iv) the 'loopless' C-lobe with TbpA plug loop inserted into the TbpB C-lobe loop 18 (SEQ.ID NO: 160). The sera were tested against the biotinylated recombinant form of the modified M982 C-lobe displaying all four of the TbpA loops inserted (SEQ.ID NO: 131). Titres were determined with 1:100,000 of goat anti-mouse IgG H+L peroxidase conjugated antibody. Endpoint titres were determined as the inverse of the last dilution at which a positive signal could be confidently detected. Each serum was run in triplicate and results are shown as the average of all mice with that treatment+/−SEM.

Example 8—Insertion of Portions of LbpA into a Modified C-Lobe of a TbpB

In this example, segments of the extracellular surface loops of the integral outer membrane protein lactoferrin binding protein A, LbpA, from strain MC58 (SEQ.ID NO: 162), were spliced into the modified TbpB C-lobe from *N. meningitidis* strain M982 (SEQ. ID NO: 129) that was described in Example 6. The reason for splicing selected regions of LbpA onto the TbpB C-lobe scaffold is that it provides a more efficient means of production than the intact LbpA protein, and provides the ability to specifically target surface regions of LbpA for induction of antibody. In conjunction with Example 7, we are able to illustrate how the generation of hybrid proteins could provide the opportunity to induce an immune response against three different proteins present on the surface of *N. meningitidis*, providing a greater barrier to potential 'vaccine escape', in which an antigenic variant of a critical target protein is able to escape the impact of the immune response generated against the vaccine antigens.

Since there were no structures available for LbpA, structural modeling of LbpA was performed using 3 web-based protein prediction servers: SWISS MODEL, I-TASSER, and PHYRE2 in an attempt to attain the most appropriate model. Initially BLAST searches were performed to find the most appropriate LbpA for modeling with the known TbpA structure (58), and revealed that the LbpA from strain MC58 (SEQ.ID NO: 130) was the most appropriate. An alignment of MC58 LbpA with K454 TbpA was generated by ClustalW and served as the input for the alignment mode in SWISS MODEL. In PHYRE2, the PDB ID for K454 TbpA structure and the FASTA sequence of MC58 LbpA were submitted as template and target, respectively. Only the FASTA sequence of MC58 LbpA was submitted to I-TASSER. The root-mean-square deviation (RMSD) was used to evaluate the similarity of the different models generated with the template structure after superimposing them in Pymol (www.pymol.org/). The LbpA model generated by PHYRE2 was selected as the most appropriate model and was used to select the loop regions for generating the hybrid or chimeric protein (FIG. 20, Panel A).

The loopless' C-lobe of the TbpB polypeptide prepared in Example 6 (SEQ.ID NO: 129) was used as a starting point. DNA encoding regions from the LbpA extracellular loop 3 and loop 2 were inserted between the DNA encoding the beta-strands flanking loops 18 and 21 of the engineered TbpB C-lobe (FIG. 20, Panel B). Loop regions in TbpB C-lobe and the corresponding loops in LbpA for insertion were analyzed for distances using Pymol to ensure the LbpA replacement loops were structured to fit within the distance parameters predicted by the loop. Assembly of the LbpA loops on the TbpB C-lobe was done using SOE PCR as in examples 6 and 7, and sequence analysis confirmed the insertion of the MC58 LbpA helix 3 and loop 2 in the loopless M982 TbpB C-lobe. The design of the hybrid protein involved insertion of 15 amino acids from the LbpA helix 3 region (protein sequence: 383-YGTDEAEK-FRDKSGV) into the loop 18 region of M982 C-lobe (SEQ.ID NO:166), and the insertion of 11 amino acids from the LbpA loop 2 region (protein sequence: LNRWVKERIEQL) into the loop 21 region of M982 C-lobe (SEQ.ID NO:164) (FIG. 20>, Panel B).

The methods for transformation of the recombinant plasmid and performing preliminary expression trials are as described for Example 7. The preliminary screen demonstrated that the yields of recombinant protein were high (bottom left, Panel B, FIG. 20), comparable or better than results with the native C-lobe or loopless C-lobe used as the scaffold (data not shown). Clearly the results further demonstrate that insertion of the foreign protein segments did not substantially affect the stability of the engineered C-lobe, suggesting that the foreign segments did not interfere with the normal folding of the core structural elements of the C-lobe.

Example 9—Engineering a Loop for Conjugate Capsular Vaccine Applications Using the TbpB C-Lobe of *H. influenzae*

The majority of the conjugate capsular vaccines that have been developed to date have used one of the toxin-based vaccine components as a carrier for conjugating the polysaccharide capsular material. There are several disadvantages to the strategy of conjugating the capsular polysaccharide to the tetanus or diphtheria toxin or toxoid. One is the potential for negatively influencing the induction of an effective immune response due to the continued exposure to the carrier proteins that are also present in vaccines used in routine immunizations; the development of immune tolerance. The second is that the carrier is not relevant to the natural exposure to the pathogen, thus will not fully take advantage of invoking the most relevant T-cell help when the pathogen is encountered.

Conjugate capsular vaccines have been very successful at preventing infection, and in fact preventing colonization, by the bacterial pathogens that express the specific capsular polysaccharide, normally referred to as the serotype or serogroup. However, there is essentially no cross-protection for bacteria expressing other polysaccharide capsular types, which can eventually lead to disease being caused by strains expressing polysaccharides not covered by the vaccine. The resulting need to expand the spectrum of polysaccharide capsular types covered by the conjugate capsular vaccines has led to the prospect of continual development of expanded spectrum vaccines and to the view that the ultimate solution lies with protein-based vaccines that are capable of providing substantial cross-protection. However, if a protein-based vaccine capable of inducing broad cross-protection was developed it is unlikely that it would be accepted to replace the existing conjugate capsular vaccines. The addition of yet another vaccine to the already crowed routine immunization schedule could be viewed as potential barrier to introduction of protein-based vaccines.

In this example we have engineered a conjugation loop into a TbpB C-lobe from *H. influenzae* that contains 42 lysine residues, substantially exceeding the total number of lysines in the remainder of the TbpB C-lobe, lysine residues, which would be predicted to minimize modification of lysines in critical epitopes since only those lysines reacting with the activated carbohydrate moieties would be modified and the ratio of carbohydrate to protein can be controlled during the conjugation process.

The sequence of the gene encoding the engineered *H. influenzae* TbpB C-lobe from strain H36 is illustrated Panel A of FIG. 21 with the DNA region encoding the conjugation loop indicated by an increased font size (14 vs 12) (SEQ.ID NO: 167). The site of insertion and the sequence of the conjugation loop was designed using the large negatively charged loop in LbpB from *N. meningitidis* strain MC58 as a model (59). Essentially the sequence of the LbpB loop was used as a template and lysines were used to replace the aspartic or glutamic acid residues in the loop. The conjugation loop was engineered onto the handle domain of the TbpB C-lobe in between beta-strands 22 and 23, in the position of loop 23 (FIG. 2). The location of the loop is illustrated in Panel B of FIG. 21 using a structural model for the *H. influenzae* C-lobe generated with a much smaller loop (comprised of 11 amino acids) replacing loop 23. The inserted residues are illustrated as space filled spheres. The engineered loop is actually comprised of 91 amino acids that constitute over ¼ of the size of the overall C-lobe (352 amino acid residues) and the loop is set forth as highlighted residues in the entire C-lobe with the engineered loop is set forth in SEQ.ID NO: 205. This shows that the loop domain can accommodate a large number of additional amino acids.

The inclusion of a conjugation region would not be restricted to insertion into the loop regions of the N-lobe or C-lobe but for instance could be provided by including a cluster of lysine residues at the N-terminus of the intact TbpB or TbpB lobes.

Example 10—Producing Amino Acid Substitutions in Surface Binding Loops of TbpB and Evaluating their Tf Binding Properties A series of site-directed mutants in the surface loops of the TbpB protein were constructed to explore their impact on functional and immunological properties. In order to target surface exposed amino acids for modification, site-directed mutations were made in TbpBs for which we had the x-ray crystallography derived structures (12, 13). A splicing by overlap extension polymerase chain reaction (SOE PCR) approach was used to introduce mutations into genes encoding truncated TbpB proteins derived from the porcine pathogens *A. pleuropneumoniae, A. suis* and H, *parasuis*. They included *A. pleuropneumoniae* $TbpB^{20-528}$ (amino acid 20-528) derived from strain H49 (ApH49 TbpB, SEQ.ID NO: 2), and a F171A mutant of ApH49 $TbpB^{20-528}$ (SEQ ID.NO: 4). Also included were *A. pleuropneumoniae* $TbpB^{26-528}$ (amino acid 26-528) derived from strain H87 (ApH87 TbpB, SEQ.ID NO:12) and a Y95A mutant (SEQ.ID NO: 14), a Y121A mutant (SEQ.ID NO: 16), a Y174A mutant (SEQ.ID NO: 18) and a R179E mutant (SEQ.ID NO: 20). *A. suis* $TbpB^{27-577}$ (amino acid 27-577) derived from strain H57 (AsH57 TbpB, SEQ.ID NO: 28), a F63A mutant (SEQ.ID NO: 30) and a F152A mutant (SEQ ID NO:32) were also produced. Finally, *H. parasuis* $TbpB^{27-577}$ (amino acid 27-577) derived from the Nagasaki strain Hp5 (Hp5 TbpB, SEQ.ID NO: 115), a Y93A mutant (SEQ.ID NO: 170), a Y117A mutant (SEQ.ID NO: 172), a Y167A mutant (SEQ.ID NO: 174), and a W176A mutant (SEQ.ID NO: 176) were also prepared.

The recombinant proteins were initially produced with an N-terminal fusion partner containing a poly-histidine tag, a maltose binding protein and a TEV protease cleavage site. This enabled us to isolate recombinant protein suitable for a solid-phase binding assay using a nitrocellulose membrane and enzymatically labeled porcine transferrin or by capturing recombinant fusion protein from crude extracts with a porcine-Sepharose affinity resin (13). Using these assays, strong binding to by the native TbpBs was readily observed, whereas there was reduced binding by many of the site-directed mutants.

Although it is possible to derive semi-quantitative binding constants for binding of porcine Tf from these experiments we opted to utilize a variety of different biophysical and biochemical approaches to obtain more accurate and quantitative measures of the binding affinity. As shown in FIG. 22, using isothermal calorimetry, surface plasmon resonance or biolayer interferometry (23-25) the affinity constant (Kd) for native TbpBs were generally in the 20 to 60 nM range, with the exception of the TbpB from *Actinobacillus suis* for which the binding kinetics were somewhat unique and had an estimated Kd of 120 nM (12).

Several of the mutations resulted in a 100 fold increase in the affinity constant (Kd), such as the F171A mutation in the TbpB from *A. pleuropneumoniae* strain H49, the Y174A mutation in the TbpB from *A. pleuropneumoniae* strain H49 or the Y167A or W176A mutations in the TbpB from *H. parasuis* strain HP5. It is interesting to note that these mutants all map to loop 8.

Example 11—Evaluating the Immunological Properties of Derivatives of TbpB with Amino Acid Substitutions in Surface Binding Loops In order to test the immunological properties of the mutant proteins derived from TbpB that were defective in binding Tf it was important to test them in the native host, and preferably directly test their ability to protect the host from infection by the targeted pathogen. Thus experiments were initiated in a well-established infection model for *Haemophilus parasuis* in which colostrum-deprived piglets were immunized starting at 28 days after birth and challenged with *Haemophilus parasuis* at day 63 (37, 60). In this infection model a commercial vaccine derived from the challenge strain (Porcillis Glasser) provided complete protection from death and recombinant forms of transferrin receptors had previously provided 20-30% survival 15 days post-challenge.

Groups of five or six pigs were immunized with recombinant intact TbpB from the Hp5 challenge strain, the site-directed Y167A TbpB protein, the Porcillis Glasser vaccine or adjuvant alone. The pigs were challenged with the standard $10^8$ challenge dose of *H. parasuis* Hp5 (Nagasaki) strain and monitored for a 15 day period. As illustrated in FIG. 23, only 1 out of five pigs immunized with the control Porcilis Glasser vaccine survived the challenge suggesting that a more virulent variant of the Hp5 strain was used in this experiment. Follow up experiments with isolates of the strain from infected pigs had lower survival rates, supporting this conclusion. In spite of the enhanced virulence of the challenge strain, all six pigs immunized with the Y167A TbpB survived 15 days, and 5 out of the 6 pigs had little or no symptoms and there was little or no pathology observed on necropsy. This level of protection was contrasted with the six pigs immunized with the wild-type protein, in which only 3 pigs survived the challenge. The 3 surviving pigs had significant clinical symptoms after challenge and showed marked pathology upon necropsy. In summary, this experiment illustrated that the Y167A TbpB mutant protein induced a superior protective immunological response compared to the wild-type protein, and since the two proteins are virtually identical except for the transferrin binding properties (FIG. 22), the suboptimal immune response by the native protein can be attributed to binding of host transferrin.

To provide further evidence of the impact that the mutation had on the immune response the B-cell and T-cell responses were evaluated. Blood samples taken immediately prior to challenge (after two immunizations) and at 96 hours after challenge were analyzed for the adaptive immune response. The samples were evaluated by FACS analysis for mature B cell ($\alpha IgM^+CD21^+$) and T helper cell ($CD4^+ CD8\alpha^-$) subsets. The results in FIG. 24 demonstrate that prior to challenge the Y167A mutant TbpB antigen had induced a stronger B-cell response (Panel A) and T helper cell response (Panel B) than the native TbpB antigen or the commercial Porcilis Glasser vaccine. At 96 hours after challenge the response to the mutant TbpB (51.48%±1.18%) was significantly higher than the response to the native TbpB (45.65%±1.20%) or PG vaccine (44.83%±1.59%) (FIG. 24, Panel C). A similar tendency was observed in the T helper cell response, however, the difference in the percentage between the three groups was less evident (FIG. 24, Panel D). However there were only 3/6 and 2/5 surviving pigs left in the groups immunized with native TbpB or the Porcilis Glasser vaccine after 96 hours, and since the low responders were the ones tending to die earlier, the observed differences between the groups at the 96 hr time point are actually an underestimate.

Example 12—An Immune Response Directed Against Derivatives of TbpB is Capable of Preventing Colonization Although infection models do provide the opportunity to evaluate the potential efficacy of vaccines, they rarely emulate the natural infectious process, in which transmission of the pathogen normally leads to colonization of the host upper respiratory tract prior to establishment of infection.

The conjugate capsular vaccines designed to prevent meningitis, pneumonia and invasive infection have been shown to eliminate the targeted bacteria from the upper respiratory tract (17), providing the additional advantage of herd immunity protecting non-immunized individuals. The ability to prevent colonization has since become an important feature for making decisions on vaccine implementation (18). Thus it may be prudent to design vaccines that prevent colonization so that along with preventing infection they can eliminate the reservoir of disease-causing pathogens.

Taking advantage of prior studies characterizing the interaction of *N. meningitidis* and human CEACAM receptors (61), we developed a transgenic humanized mouse model capable of supporting colonization by *Neisseria meningitidis* (62). This model is based on a specific interaction of *Neisseria meningitidis* Opa proteins with the human CEACAM1 receptor, and could potentially be extended to other pathogens that naturally or artificially exploit this interaction. Immunization of the transgenic mice with a meningococcal group C conjugate capsular vaccine resulted in sterilizing mucosal immunity in the colonization model, or in other words, prevented colonization by group C *Neisseria meningitidis* but not strains with other capsular types.

This model was used to test the ability of TbpB and its derivatives to prevent colonization by *N. meningitidis*. Since there is no human transferrin present in these mice during the immunization stage, it was not necessary to use an engineered non-binding TbpB as was described in Example 11. As illustrated in FIG. 25A, 8 out of 9 mice immunized with recombinant truncated TbpB did not have detectable levels of *N. meningitidis* three days after an intranasal challenge with $1\times10^7$ CFU of *N. meningitidis* strain M982. In the control mice treated with adjuvant alone, 6 out of 8 mice had detectable levels of *N. meningitidis* present. It is salient to mention that this is first protein antigen shown to be capable of preventing colonization and this feature cannot be assumed to be common to surface protein antigens due to our limited understanding of the mechanisms involved.

In a follow up experiment we compared TbpB to another surface lipoprotein, factor H binding protein, which is a key component in two vaccines, and to the individual TbpB subdomains. As illustrated in FIG. 25B the C-lobe was capable of preventing colonization as well as or better than the intact TbpB or TbpB N-lobe, which in turn were as effective or more effective than factor H binding protein at inducing sterilizing immunity in this experiment. The ability of the TbpB C-lobe to induce sterilizing mucosal immunity with systemic immunization is a particularly encouraging finding as its lack of Tf binding means that it will be equally effective in the native host, and its enhanced ability to induce a cross-reactive immune response (FIG. 3, FIG. 11) will facilitate the development of broadly cross-protective vaccines.

The colonization studies were performed as described previously (62). Groups of 8 or more C57/B16 expressing the human CEACAM-1 transgene (bred in-house) received 100 ul of designated immunizations subcutaneously on days 0 and 21. Groups received either the designated protein (25 ug) or no protein control adjuvanted with 20% Emulsigen D (MVP Laboratories) diluted in sterile phosphate buffered saline (PBS) (Gibco) to a volume of 100 ul per injection.

On day 35, mice were anesthetized with Isofluran (Baxter) and inoculated via intranasal instillation with the twice animal passaged *N. meningitidis* strain M982. To prepare inoculums, bacterial strains for infection were grown overnight on GC agar (Becktion Dickinson); the overnight lawn of growth was harvested into 1 ml of PBS containing 1 mM of MgCl2 (PBS/Mg) and OD600 was measured to adjust the number of bacteria. Cultures were adjusted such that each final 10 μl inoculum contained approximately $1\times10^7$ colony forming units. Density of colonization dose was confirmed via serial dilution plating on GC agar.

Three days after infection (day 38), mice were euthanized by carbon dioxide asphyxiation. Burden of colonization was assessed by tracheal lavage with 250 ul PBS/Mg followed by direct swabbing of the nasal passages with a polyester tipped applicator (Puritan Medical Products) resuspended in 500 ul PBS/Mg. Samples were enumerated after overnight growth on GC agar supplemented with VCNT inhibitor (Becton Dickinson) to prevent growth of nasal flora. Animal experiments were conducted in accordance with the Animal Ethics Review Committee of the University of Toronto.

Example 13—Vaccine Formulation Comprising Mixtures of TbpBs or Portions Thereof

Since the pathogens that possess TbpB reside exclusively in their specific host (humans, pigs, cattle and/or related ruminants) and since TbpB is capable of preventing colonization (FIG. 25), a broadly cross-protective vaccine based on engineered antigens targeting TbpB has the potential of eliminating the pathogen.

In order to broaden the efficacy of a vaccine formulation against a spectrum of Gram-negative pathogens, TbpBs, or portions thereof, e.g. a C-lobe domain, obtained from different bacterial species or strains may be combined. In this Example we provide preferred combinations of TbpB polypeptides or combinations thereof for use in the preparation of vaccine formulations.

One important consideration in identifying efficacious combinations of TbpB polypeptides is the extent to which different strains, species and genera are capable of readily exchanging the tbpB genes, thus acting as a potential reservoir for TbpB variants not covered by the vaccine. One of the important factors influencing the horizontal exchange of tbpB genes is the nature of the uptake signal sequence (USS) that is inherently present in these naturally transformable species (63, 64). These bacteria preferentially take up DNA containing the specific USS and incorporate it into their genome, providing a very efficient mechanism for incorporating antigenic variants of their surface antigens.

In the case of *Neisseria meningitidis* we have an extensive strain collection that adequately represented the overall sequence diversity (FIG. 10A). There is a particularly large collection of sequences from around the world available on public databases for this pathogen that represents a very comprehensive appreciation of sequence diversity. Since the other human pathogens that possess TbpBs and normally reside in the human upper respiratory tract (*Haemophilus influenzae, Moraxella catarrhalis*) do not contain the USS specific to *Neisseria* in their genomic DNA, they do not constitute a ready reservoir for antigen variants. Thus the present example includes a vaccine formulation comprising a combination of engineered TbpB antigens, comprising at least two TbpB polypeptides, or a portion thereof (e.g. the C-lobe domain) obtained from *Neisseria meningitidis* strains selected from two different phylogenetic clusters set forth in FIG. 10A. Such vaccine formulation is potentially capable of inducing a cross-reactive (FIG. 11) and cross-protective antibody response, could potentially be used to eliminate *N. meningitidis* from the human population.

The related pathogen, *N. gonorrhoeae*, that normally resides in the human genitourinary tract shares the same USS thus could potentially serve as a reserve for antigenic variation due to the occasional presence of these two species on the same mucosal surface. However, analysis of the sequence diversity of the gonococcal TbpBs relative to diversity in *N. meningitidis* (FIG. 26A) indicates that they are largely a subset of the sequence diversity present in *N. meningitidis* leading to the prospect that by a slight extension of our approach a set of engineered antigens could be used for a vaccine potentially capable of eliminating colonization by either pathogen. For engineered C-lobes (FIG. 26B) it would involve inclusion of C-lobes specifically targeting *N. gonorrhoeae* TbpB variants. The presence of TbpB in some of the commensal *Neisseria* isolates represents another potential reservoir for antigenic variants, thus extension of our approach to include representative variants from commensal *Neisseria* might be necessary to effectively eliminate TbpB expressing *Neisseria* capable of causing disease. Thus the present example includes a vaccine formulation comprising a combination of engineered TbpB antigens, comprising a *Neisseria meningitidis* TbpB polypeptide, or a portion thereof (e.g. a C-lobe domain), and a *Neisseria gonorrhoeae* TbpB polypeptide or a portion thereof (e.g. a C-lobe domain).

The porcine pathogens *A. pleuropneumoniae, A. suis* and *H. parasuis* share the same USS and, as a consequence, the TbpB sequence diversity is distributed amongst the three species (FIG. 4) such that the main phylogenetic clusters have representatives from at least two species. Thus it is important to consider the overall TbpB sequence variation in all three species when developing TbpB-based vaccines against these pathogens. This is the foundation for our rather unconventional approach of developing engineered antigens capable of inducing an immune response against antigens from more that one species (FIG. 6, FIG. 7), and since TbpB is capable of preventing colonization, are using an approach that could be used to eliminate all three pathogens from their porcine host. Thus the present example includes a vaccine formulation comprising a combination of engineered TbpB antigens, comprising at least two TbpB polypeptides, or a portion thereof (e.g. a C-lobe domain) obtained from *Actinobacillus pleuropneumoniae, Actinobacillus suis* and *Haemophilus parasuis*.

In regards to *Haemophilus influenzae*, the distinctly different spectrum of disease caused by the strains possessing the type b polysaccharide capsule and the non-typeable strains that lack a polysaccharide capsule have prompted focus on vaccines that target each group separately. Recent increases in invasive disease due to strains expressing the group A polysaccharide capsule has prompted consideration for development of vaccines targeting group A strains (65). An evaluation of TbpB diversity in strains of *H. influenzae* indicates that there are three major phylogenetic clusters (FIG. 27A) with the non-typeable strains distributed amongst all three groups. Since all strains of *H. influenzae* share the same USS, it is likely that the distribution of TbpB diversity will not be impacted by capsular type, and the development of a cross-protective vaccine derived from TbpB-based engineered antigens will effectively target type b strains, non-typeable strains and strains expressing other capsular types. Thus our approach should facilitate the development of a broadly-protective TbpB-based vaccine for *H. influenzae* as a stand-alone vaccine, or as a carrier for a conjugate capsular vaccines (FIG. 21). Thus the present example includes a vaccine formulation comprising a combination of engineered TbpB antigens, comprising at least two TbpB polypeptides, obtained from *H. influenzae* strains selected from two different phylogenetic clusters set forth in FIG. 27A.

Unlike *Neisseria meningitidis* and *Haemophilus influenzae*, there are no obvious USSs present in the genomes of *Moraxella catarrhalis* strains, yet they are naturally transformable with a strong preference for *M. catarrhalis* DNA. Thus development of a broadly cross-protective vaccine against *M. catarrhalis* with engineered antigens targeting TbpB need only consider the diversity of TbpBs from *M. catarrhalis* (FIG. 29). Antigens derived from strains constituting the three major groups should be sufficient to induce a broadly cross-protective vaccine capable of preventing colonization by *M. catarrhalis*. Thus the present example includes a vaccine formulation comprising a combination of engineered TbpB antigens, comprising at least two TbpB polypeptides, obtained from *M. catarrhalis* strains selected from two different phylogenetic clusters set forth in FIG. 29.

The bovine pathogen *Mannhemia haemolytica*, formerly known as *Pasteurella haemolytica*, is major cause of bovine respiratory disease (shipping fever) in cattle and respiratory infections in sheep. The sheep pathogen, *Pasteurella trehalosi*, that has been reclassified into two species *Mannhemia glucosida* and *Bibersteinia trehalosi*, shares USSs with *Mannhemia haemolytica*. This may be largely responsible for the finding that these species share a common gene pool (66). In contrast the bovine pathogen, *Histophilus somni*, formerly known as *Haemophilus somnus*, has a distinct USS, thus is not a reservoir of antigenic variants for *M. haemolytica*. There are three main phylogenetic lineages of TbpBs from *M. haemolytica, M. glucosida* and *B. trehalosi* that obviously encompass pathogens of sheep and cattle (66) (FIG. 28) with clusters of variants that are primarily restricted to cattle or sheep. Thus it will be possible to consider development of TbpB-derived engineered antigens targeting disease in cattle, in sheep or in both ruminant species. Thus the present example includes a vaccine formulation comprising a combination of engineered TbpB antigens, or a portion thereof e.g. the C-lobe domain, comprising at least two TbpB polypeptides, obtained from *Mannheimia haemolytica, Mannheimia glucosida* and *Bibersteinia trehalosi* strains selected from two different phylogenetic clusters set forth in FIG. 28.

All publications, patents and patent applications are herein incorporated by reference in their entirety to the same extent as if each individual publication, patent or patent application was specifically and individually indicated to be incorporated by reference in its entirety.

TABLE 1

| Modification of 1 loop | |
|---|---|
| L1 | ✓ |
| L2 | ✓ |
| L3 | ✓ |
| L4 | ✓ |
| L5 | ✓ |
| L6 | ✓ |
| L7 | ✓ |
| L8 | ✓ |
| L9 | ✓ |
| L10 | ✓ |
| L11 | ✓ |
| L12 | ✓ |
| L13 | ✓ |
| L14 | ✓ |
| L15 | ✓ |
| L16 | ✓ |
| L17 | ✓ |

TABLE 1-continued

Modification of 1 loop

| | |
|---|---|
| L18 | ✓ |
| L19 | ✓ |
| L20 | ✓ |
| L21 | ✓ |
| L22 | ✓ |
| L23 | ✓ |
| L24 | ✓ |
| L25 | ✓ |
| L26 | ✓ |
| L27 | ✓ |
| L28 | ✓ |
| L29 | ✓ |
| L30 | ✓ |
| L31 | ✓ |
| L32 | ✓ |

TABLE 2

Modification of 2 loops

| | L1 | L2 | L3 | L4 | L5 | L6 | L7 | L8 | L9 | L10 | L11 | L12 | L13 | L14 | L15 | L16 | L17 | L18 |
|---|---|---|---|---|---|---|---|---|---|---|---|---|---|---|---|---|---|---|
| L1 | x | | | | | | | | | | | | | | | | | |
| L2 | ✓ | x | | | | | | | | | | | | | | | | |
| L3 | ✓ | ✓ | x | | | | | | | | | | | | | | | |
| L4 | ✓ | ✓ | ✓ | x | | | | | | | | | | | | | | |
| L5 | ✓ | ✓ | ✓ | ✓ | x | | | | | | | | | | | | | |
| L6 | ✓ | ✓ | ✓ | ✓ | ✓ | x | | | | | | | | | | | | |
| L7 | ✓ | ✓ | ✓ | ✓ | ✓ | ✓ | x | | | | | | | | | | | |
| L8 | ✓ | ✓ | ✓ | ✓ | ✓ | ✓ | ✓ | x | | | | | | | | | | |
| L9 | ✓ | ✓ | ✓ | ✓ | ✓ | ✓ | ✓ | ✓ | x | | | | | | | | | |
| L10 | ✓ | ✓ | ✓ | ✓ | ✓ | ✓ | ✓ | ✓ | ✓ | x | | | | | | | | |
| L11 | ✓ | ✓ | ✓ | ✓ | ✓ | ✓ | ✓ | ✓ | ✓ | ✓ | x | | | | | | | |
| L12 | ✓ | ✓ | ✓ | ✓ | ✓ | ✓ | ✓ | ✓ | ✓ | ✓ | ✓ | x | | | | | | |
| L13 | ✓ | ✓ | ✓ | ✓ | ✓ | ✓ | ✓ | ✓ | ✓ | ✓ | ✓ | ✓ | x | | | | | |
| L14 | ✓ | ✓ | ✓ | ✓ | ✓ | ✓ | ✓ | ✓ | ✓ | ✓ | ✓ | ✓ | ✓ | x | | | | |
| L15 | ✓ | ✓ | ✓ | ✓ | ✓ | ✓ | ✓ | ✓ | ✓ | ✓ | ✓ | ✓ | ✓ | ✓ | x | | | |
| L16 | ✓ | ✓ | ✓ | ✓ | ✓ | ✓ | ✓ | ✓ | ✓ | ✓ | ✓ | ✓ | ✓ | ✓ | ✓ | x | | |
| L17 | ✓ | ✓ | ✓ | ✓ | ✓ | ✓ | ✓ | ✓ | ✓ | ✓ | ✓ | ✓ | ✓ | ✓ | ✓ | ✓ | x | |
| L18 | ✓ | ✓ | ✓ | ✓ | ✓ | ✓ | ✓ | ✓ | ✓ | ✓ | ✓ | ✓ | ✓ | ✓ | ✓ | ✓ | ✓ | x |
| L19 | ✓ | ✓ | ✓ | ✓ | ✓ | ✓ | ✓ | ✓ | ✓ | ✓ | ✓ | ✓ | ✓ | ✓ | ✓ | ✓ | ✓ | ✓ |
| L20 | ✓ | ✓ | ✓ | ✓ | ✓ | ✓ | ✓ | ✓ | ✓ | ✓ | ✓ | ✓ | ✓ | ✓ | ✓ | ✓ | ✓ | ✓ |
| L21 | ✓ | ✓ | ✓ | ✓ | ✓ | ✓ | ✓ | ✓ | ✓ | ✓ | ✓ | ✓ | ✓ | ✓ | ✓ | ✓ | ✓ | ✓ |
| L22 | ✓ | ✓ | ✓ | ✓ | ✓ | ✓ | ✓ | ✓ | ✓ | ✓ | ✓ | ✓ | ✓ | ✓ | ✓ | ✓ | ✓ | ✓ |
| L23 | ✓ | ✓ | ✓ | ✓ | ✓ | ✓ | ✓ | ✓ | ✓ | ✓ | ✓ | ✓ | ✓ | ✓ | ✓ | ✓ | ✓ | ✓ |
| L24 | ✓ | ✓ | ✓ | ✓ | ✓ | ✓ | ✓ | ✓ | ✓ | ✓ | ✓ | ✓ | ✓ | ✓ | ✓ | ✓ | ✓ | ✓ |
| L25 | ✓ | ✓ | ✓ | ✓ | ✓ | ✓ | ✓ | ✓ | ✓ | ✓ | ✓ | ✓ | ✓ | ✓ | ✓ | ✓ | ✓ | ✓ |
| L26 | ✓ | ✓ | ✓ | ✓ | ✓ | ✓ | ✓ | ✓ | ✓ | ✓ | ✓ | ✓ | ✓ | ✓ | ✓ | ✓ | ✓ | ✓ |
| L27 | ✓ | ✓ | ✓ | ✓ | ✓ | ✓ | ✓ | ✓ | ✓ | ✓ | ✓ | ✓ | ✓ | ✓ | ✓ | ✓ | ✓ | ✓ |
| L28 | ✓ | ✓ | ✓ | ✓ | ✓ | ✓ | ✓ | ✓ | ✓ | ✓ | ✓ | ✓ | ✓ | ✓ | ✓ | ✓ | ✓ | ✓ |
| L29 | ✓ | ✓ | ✓ | ✓ | ✓ | ✓ | ✓ | ✓ | ✓ | ✓ | ✓ | ✓ | ✓ | ✓ | ✓ | ✓ | ✓ | ✓ |
| L30 | ✓ | ✓ | ✓ | ✓ | ✓ | ✓ | ✓ | ✓ | ✓ | ✓ | ✓ | ✓ | ✓ | ✓ | ✓ | ✓ | ✓ | ✓ |
| L31 | ✓ | ✓ | ✓ | ✓ | ✓ | ✓ | ✓ | ✓ | ✓ | ✓ | ✓ | ✓ | ✓ | ✓ | ✓ | ✓ | ✓ | ✓ |
| L32 | ✓ | ✓ | ✓ | ✓ | ✓ | ✓ | ✓ | ✓ | ✓ | ✓ | ✓ | ✓ | ✓ | ✓ | ✓ | ✓ | ✓ | ✓ |

| | L19 | L20 | L21 | L22 | L23 | L24 | L25 | L26 | L27 | L28 | L29 | L30 | L31 | L32 |
|---|---|---|---|---|---|---|---|---|---|---|---|---|---|---|
| L1 | | | | | | | | | | | | | | |
| L2 | | | | | | | | | | | | | | |
| L3 | | | | | | | | | | | | | | |
| L4 | | | | | | | | | | | | | | |
| L5 | | | | | | | | | | | | | | |
| L6 | | | | | | | | | | | | | | |
| L7 | | | | | | | | | | | | | | |
| L8 | | | | | | | | | | | | | | |
| L9 | | | | | | | | | | | | | | |
| L10 | | | | | | | | | | | | | | |
| L11 | | | | | | | | | | | | | | |
| L12 | | | | | | | | | | | | | | |
| L13 | | | | | | | | | | | | | | |
| L14 | | | | | | | | | | | | | | |
| L15 | | | | | | | | | | | | | | |
| L16 | | | | | | | | | | | | | | |
| L17 | | | | | | | | | | | | | | |
| L18 | | | | | | | | | | | | | | |
| L19 | x | | | | | | | | | | | | | |
| L20 | ✓ | x | | | | | | | | | | | | |
| L21 | ✓ | ✓ | x | | | | | | | | | | | |
| L22 | ✓ | ✓ | ✓ | x | | | | | | | | | | |
| L23 | ✓ | ✓ | ✓ | ✓ | x | | | | | | | | | |
| L24 | ✓ | ✓ | ✓ | ✓ | ✓ | x | | | | | | | | |
| L25 | ✓ | ✓ | ✓ | ✓ | ✓ | ✓ | x | | | | | | | |
| L26 | ✓ | ✓ | ✓ | ✓ | ✓ | ✓ | ✓ | x | | | | | | |

TABLE 2-continued

| | | | | | | | | | | | | | | |
|---|---|---|---|---|---|---|---|---|---|---|---|---|---|---|
| Modification of 2 loops | | | | | | | | | | | | | | |
| L27 | ✓ | ✓ | ✓ | ✓ | ✓ | ✓ | ✓ | ✓ | x | | | | | |
| L28 | ✓ | ✓ | ✓ | ✓ | ✓ | ✓ | ✓ | ✓ | ✓ | x | | | | |
| L29 | ✓ | ✓ | ✓ | ✓ | ✓ | ✓ | ✓ | ✓ | ✓ | ✓ | x | | | |
| L30 | ✓ | ✓ | ✓ | ✓ | ✓ | ✓ | ✓ | ✓ | ✓ | ✓ | ✓ | x | | |
| L31 | ✓ | ✓ | ✓ | ✓ | ✓ | ✓ | ✓ | ✓ | ✓ | ✓ | ✓ | ✓ | x | |
| L32 | ✓ | ✓ | ✓ | ✓ | ✓ | ✓ | ✓ | ✓ | ✓ | ✓ | ✓ | ✓ | ✓ | x |

TABLE 3

| | L1 | L2 | L3 | L4 | L5 | L6 | L7 | L8 | L9 | L10 | L11 | L12 | L13 | L14 | L15 | L16 | L17 | L18 |
|---|---|---|---|---|---|---|---|---|---|---|---|---|---|---|---|---|---|---|
| Modification of 3 loops | | | | | | | | | | | | | | | | | | |
| L1 + L2 | x | x | | | | | | | | | | | | | | | | |
| L1 + L3 | x | ✓ | x | | | | | | | | | | | | | | | |
| L1 + L4 | x | ✓ | ✓ | x | | | | | | | | | | | | | | |
| L1 + L5 | x | ✓ | ✓ | ✓ | x | | | | | | | | | | | | | |
| L1 + L6 | x | ✓ | ✓ | ✓ | ✓ | x | | | | | | | | | | | | |
| L1 + L7 | x | ✓ | ✓ | ✓ | ✓ | ✓ | x | | | | | | | | | | | |
| L1 + L8 | x | ✓ | ✓ | ✓ | ✓ | ✓ | ✓ | x | | | | | | | | | | |
| L1 + L9 | x | ✓ | ✓ | ✓ | ✓ | ✓ | ✓ | ✓ | x | | | | | | | | | |
| L1 + L10 | x | ✓ | ✓ | ✓ | ✓ | ✓ | ✓ | ✓ | ✓ | x | | | | | | | | |
| L1 + L11 | x | ✓ | ✓ | ✓ | ✓ | ✓ | ✓ | ✓ | ✓ | ✓ | x | | | | | | | |
| L1 + L12 | x | ✓ | ✓ | ✓ | ✓ | ✓ | ✓ | ✓ | ✓ | ✓ | ✓ | x | | | | | | |
| L1 + L13 | x | ✓ | ✓ | ✓ | ✓ | ✓ | ✓ | ✓ | ✓ | ✓ | ✓ | ✓ | x | | | | | |
| L1 + L14 | x | ✓ | ✓ | ✓ | ✓ | ✓ | ✓ | ✓ | ✓ | ✓ | ✓ | ✓ | ✓ | x | | | | |
| L1 + L15 | x | ✓ | ✓ | ✓ | ✓ | ✓ | ✓ | ✓ | ✓ | ✓ | ✓ | ✓ | ✓ | ✓ | x | | | |
| L1 + L16 | x | ✓ | ✓ | ✓ | ✓ | ✓ | ✓ | ✓ | ✓ | ✓ | ✓ | ✓ | ✓ | ✓ | ✓ | x | | |
| L1 + L17 | x | ✓ | ✓ | ✓ | ✓ | ✓ | ✓ | ✓ | ✓ | ✓ | ✓ | ✓ | ✓ | ✓ | ✓ | ✓ | x | |
| L1 + L18 | x | ✓ | ✓ | ✓ | ✓ | ✓ | ✓ | ✓ | ✓ | ✓ | ✓ | ✓ | ✓ | ✓ | ✓ | ✓ | ✓ | x |
| L1 + L19 | x | ✓ | ✓ | ✓ | ✓ | ✓ | ✓ | ✓ | ✓ | ✓ | ✓ | ✓ | ✓ | ✓ | ✓ | ✓ | ✓ | ✓ |
| L1 + L20 | x | ✓ | ✓ | ✓ | ✓ | ✓ | ✓ | ✓ | ✓ | ✓ | ✓ | ✓ | ✓ | ✓ | ✓ | ✓ | ✓ | ✓ |
| L1 + L21 | x | ✓ | ✓ | ✓ | ✓ | ✓ | ✓ | ✓ | ✓ | ✓ | ✓ | ✓ | ✓ | ✓ | ✓ | ✓ | ✓ | ✓ |
| L1 + L22 | x | ✓ | ✓ | ✓ | ✓ | ✓ | ✓ | ✓ | ✓ | ✓ | ✓ | ✓ | ✓ | ✓ | ✓ | ✓ | ✓ | ✓ |
| L1 + L23 | x | ✓ | ✓ | ✓ | ✓ | ✓ | ✓ | ✓ | ✓ | ✓ | ✓ | ✓ | ✓ | ✓ | ✓ | ✓ | ✓ | ✓ |
| L1 + L24 | x | ✓ | ✓ | ✓ | ✓ | ✓ | ✓ | ✓ | ✓ | ✓ | ✓ | ✓ | ✓ | ✓ | ✓ | ✓ | ✓ | ✓ |
| L1 + L25 | x | ✓ | ✓ | ✓ | ✓ | ✓ | ✓ | ✓ | ✓ | ✓ | ✓ | ✓ | ✓ | ✓ | ✓ | ✓ | ✓ | ✓ |
| L1 + L26 | x | ✓ | ✓ | ✓ | ✓ | ✓ | ✓ | ✓ | ✓ | ✓ | ✓ | ✓ | ✓ | ✓ | ✓ | ✓ | ✓ | ✓ |
| L1 + L27 | x | ✓ | ✓ | ✓ | ✓ | ✓ | ✓ | ✓ | ✓ | ✓ | ✓ | ✓ | ✓ | ✓ | ✓ | ✓ | ✓ | ✓ |
| L1 + L28 | x | ✓ | ✓ | ✓ | ✓ | ✓ | ✓ | ✓ | ✓ | ✓ | ✓ | ✓ | ✓ | ✓ | ✓ | ✓ | ✓ | ✓ |
| L1 + L29 | x | ✓ | ✓ | ✓ | ✓ | ✓ | ✓ | ✓ | ✓ | ✓ | ✓ | ✓ | ✓ | ✓ | ✓ | ✓ | ✓ | ✓ |
| L1 + L30 | x | ✓ | ✓ | ✓ | ✓ | ✓ | ✓ | ✓ | ✓ | ✓ | ✓ | ✓ | ✓ | ✓ | ✓ | ✓ | ✓ | ✓ |
| L1 + L31 | x | ✓ | ✓ | ✓ | ✓ | ✓ | ✓ | ✓ | ✓ | ✓ | ✓ | ✓ | ✓ | ✓ | ✓ | ✓ | ✓ | ✓ |
| L1 + L32 | x | ✓ | ✓ | ✓ | ✓ | ✓ | ✓ | ✓ | ✓ | ✓ | ✓ | ✓ | ✓ | ✓ | ✓ | ✓ | ✓ | ✓ |
| L2 + L3 | | x | x | | | | | | | | | | | | | | | |
| L2 + L4 | | x | ✓ | x | | | | | | | | | | | | | | |
| L2 + L5 | | x | ✓ | ✓ | x | | | | | | | | | | | | | |
| L2 + L6 | | x | ✓ | ✓ | ✓ | x | | | | | | | | | | | | |
| L2 + L7 | | x | ✓ | ✓ | ✓ | ✓ | x | | | | | | | | | | | |
| L2 + L8 | | x | ✓ | ✓ | ✓ | ✓ | ✓ | x | | | | | | | | | | |
| L2 + L9 | | x | ✓ | ✓ | ✓ | ✓ | ✓ | ✓ | x | | | | | | | | | |
| L2 + L10 | | x | ✓ | ✓ | ✓ | ✓ | ✓ | ✓ | ✓ | x | | | | | | | | |
| L2 + L11 | | x | ✓ | ✓ | ✓ | ✓ | ✓ | ✓ | ✓ | ✓ | x | | | | | | | |
| L2 + L12 | | x | ✓ | ✓ | ✓ | ✓ | ✓ | ✓ | ✓ | ✓ | ✓ | x | | | | | | |
| L2 + L13 | | x | ✓ | ✓ | ✓ | ✓ | ✓ | ✓ | ✓ | ✓ | ✓ | ✓ | x | | | | | |
| L2 + L14 | | x | ✓ | ✓ | ✓ | ✓ | ✓ | ✓ | ✓ | ✓ | ✓ | ✓ | ✓ | x | | | | |
| L2 + L15 | | x | ✓ | ✓ | ✓ | ✓ | ✓ | ✓ | ✓ | ✓ | ✓ | ✓ | ✓ | ✓ | x | | | |
| L2 + L16 | | x | ✓ | ✓ | ✓ | ✓ | ✓ | ✓ | ✓ | ✓ | ✓ | ✓ | ✓ | ✓ | ✓ | x | | |
| L2 + L17 | | x | ✓ | ✓ | ✓ | ✓ | ✓ | ✓ | ✓ | ✓ | ✓ | ✓ | ✓ | ✓ | ✓ | ✓ | x | |
| L2 + L18 | | x | ✓ | ✓ | ✓ | ✓ | ✓ | ✓ | ✓ | ✓ | ✓ | ✓ | ✓ | ✓ | ✓ | ✓ | ✓ | x |
| L2 + L19 | | x | ✓ | ✓ | ✓ | ✓ | ✓ | ✓ | ✓ | ✓ | ✓ | ✓ | ✓ | ✓ | ✓ | ✓ | ✓ | ✓ |
| L2 + L20 | | x | ✓ | ✓ | ✓ | ✓ | ✓ | ✓ | ✓ | ✓ | ✓ | ✓ | ✓ | ✓ | ✓ | ✓ | ✓ | ✓ |
| L2 + L21 | | x | ✓ | ✓ | ✓ | ✓ | ✓ | ✓ | ✓ | ✓ | ✓ | ✓ | ✓ | ✓ | ✓ | ✓ | ✓ | ✓ |
| L2 + L22 | | x | ✓ | ✓ | ✓ | ✓ | ✓ | ✓ | ✓ | ✓ | ✓ | ✓ | ✓ | ✓ | ✓ | ✓ | ✓ | ✓ |
| L2 + L23 | | x | ✓ | ✓ | ✓ | ✓ | ✓ | ✓ | ✓ | ✓ | ✓ | ✓ | ✓ | ✓ | ✓ | ✓ | ✓ | ✓ |
| L2 + L24 | | x | ✓ | ✓ | ✓ | ✓ | ✓ | ✓ | ✓ | ✓ | ✓ | ✓ | ✓ | ✓ | ✓ | ✓ | ✓ | ✓ |
| L2 + L25 | | x | ✓ | ✓ | ✓ | ✓ | ✓ | ✓ | ✓ | ✓ | ✓ | ✓ | ✓ | ✓ | ✓ | ✓ | ✓ | ✓ |
| L2 + L26 | | x | ✓ | ✓ | ✓ | ✓ | ✓ | ✓ | ✓ | ✓ | ✓ | ✓ | ✓ | ✓ | ✓ | ✓ | ✓ | ✓ |
| L2 + L27 | | x | ✓ | ✓ | ✓ | ✓ | ✓ | ✓ | ✓ | ✓ | ✓ | ✓ | ✓ | ✓ | ✓ | ✓ | ✓ | ✓ |
| L2 + L28 | | x | ✓ | ✓ | ✓ | ✓ | ✓ | ✓ | ✓ | ✓ | ✓ | ✓ | ✓ | ✓ | ✓ | ✓ | ✓ | ✓ |
| L2 + L29 | | x | ✓ | ✓ | ✓ | ✓ | ✓ | ✓ | ✓ | ✓ | ✓ | ✓ | ✓ | ✓ | ✓ | ✓ | ✓ | ✓ |
| L2 + L30 | | x | ✓ | ✓ | ✓ | ✓ | ✓ | ✓ | ✓ | ✓ | ✓ | ✓ | ✓ | ✓ | ✓ | ✓ | ✓ | ✓ |
| L2 + L31 | | x | ✓ | ✓ | ✓ | ✓ | ✓ | ✓ | ✓ | ✓ | ✓ | ✓ | ✓ | ✓ | ✓ | ✓ | ✓ | ✓ |
| L2 + L32 | | x | ✓ | ✓ | ✓ | ✓ | ✓ | ✓ | ✓ | ✓ | ✓ | ✓ | ✓ | ✓ | ✓ | ✓ | ✓ | ✓ |
| L3 + L4 | | | x | x | | | | | | | | | | | | | | |

TABLE 3-continued

Modification of 3 loops

| | L3 | L4 | L5 | L6 | L7 | L8 | L9 | L10 | L11 | L12 | L13 | L14 | L15 | L16 | L17 | L18 | L19 |
|---|---|---|---|---|---|---|---|---|---|---|---|---|---|---|---|---|---|
| L3 + L5 | x | ✓ | x | | | | | | | | | | | | | | |
| L3 + L6 | x | ✓ | ✓ | x | | | | | | | | | | | | | |
| L3 + L7 | x | ✓ | ✓ | ✓ | x | | | | | | | | | | | | |
| L3 + L8 | x | ✓ | ✓ | ✓ | ✓ | x | | | | | | | | | | | |
| L3 + L9 | x | ✓ | ✓ | ✓ | ✓ | ✓ | x | | | | | | | | | | |
| L3 + L10 | x | ✓ | ✓ | ✓ | ✓ | ✓ | ✓ | x | | | | | | | | | |
| L3 + L11 | x | ✓ | ✓ | ✓ | ✓ | ✓ | ✓ | ✓ | x | | | | | | | | |
| L3 + L12 | x | ✓ | ✓ | ✓ | ✓ | ✓ | ✓ | ✓ | ✓ | x | | | | | | | |
| L3 + L13 | x | ✓ | ✓ | ✓ | ✓ | ✓ | ✓ | ✓ | ✓ | ✓ | x | | | | | | |
| L3 + L14 | x | ✓ | ✓ | ✓ | ✓ | ✓ | ✓ | ✓ | ✓ | ✓ | ✓ | x | | | | | |
| L3 + L15 | x | ✓ | ✓ | ✓ | ✓ | ✓ | ✓ | ✓ | ✓ | ✓ | ✓ | ✓ | x | | | | |
| L3 + L16 | x | ✓ | ✓ | ✓ | ✓ | ✓ | ✓ | ✓ | ✓ | ✓ | ✓ | ✓ | ✓ | x | | | |
| L3 + L17 | x | ✓ | ✓ | ✓ | ✓ | ✓ | ✓ | ✓ | ✓ | ✓ | ✓ | ✓ | ✓ | ✓ | x | | |
| L3 + L18 | x | ✓ | ✓ | ✓ | ✓ | ✓ | ✓ | ✓ | ✓ | ✓ | ✓ | ✓ | ✓ | ✓ | ✓ | x | |
| L3 + L19 | x | ✓ | ✓ | ✓ | ✓ | ✓ | ✓ | ✓ | ✓ | ✓ | ✓ | ✓ | ✓ | ✓ | ✓ | ✓ | ✓ |
| L3 + L20 | x | ✓ | ✓ | ✓ | ✓ | ✓ | ✓ | ✓ | ✓ | ✓ | ✓ | ✓ | ✓ | ✓ | ✓ | ✓ | ✓ |
| L3 + L21 | x | ✓ | ✓ | ✓ | ✓ | ✓ | ✓ | ✓ | ✓ | ✓ | ✓ | ✓ | ✓ | ✓ | ✓ | ✓ | ✓ |
| L3 + L22 | x | ✓ | ✓ | ✓ | ✓ | ✓ | ✓ | ✓ | ✓ | ✓ | ✓ | ✓ | ✓ | ✓ | ✓ | ✓ | ✓ |
| L3 + L23 | x | ✓ | ✓ | ✓ | ✓ | ✓ | ✓ | ✓ | ✓ | ✓ | ✓ | ✓ | ✓ | ✓ | ✓ | ✓ | ✓ |
| L3 + L24 | x | ✓ | ✓ | ✓ | ✓ | ✓ | ✓ | ✓ | ✓ | ✓ | ✓ | ✓ | ✓ | ✓ | ✓ | ✓ | ✓ |
| L3 + L25 | x | ✓ | ✓ | ✓ | ✓ | ✓ | ✓ | ✓ | ✓ | ✓ | ✓ | ✓ | ✓ | ✓ | ✓ | ✓ | ✓ |
| L3 + L26 | x | ✓ | ✓ | ✓ | ✓ | ✓ | ✓ | ✓ | ✓ | ✓ | ✓ | ✓ | ✓ | ✓ | ✓ | ✓ | ✓ |
| L3 + L27 | x | ✓ | ✓ | ✓ | ✓ | ✓ | ✓ | ✓ | ✓ | ✓ | ✓ | ✓ | ✓ | ✓ | ✓ | ✓ | ✓ |
| L3 + L28 | x | ✓ | ✓ | ✓ | ✓ | ✓ | ✓ | ✓ | ✓ | ✓ | ✓ | ✓ | ✓ | ✓ | ✓ | ✓ | ✓ |
| L3 + L29 | x | ✓ | ✓ | ✓ | ✓ | ✓ | ✓ | ✓ | ✓ | ✓ | ✓ | ✓ | ✓ | ✓ | ✓ | ✓ | ✓ |
| L3 + L30 | x | ✓ | ✓ | ✓ | ✓ | ✓ | ✓ | ✓ | ✓ | ✓ | ✓ | ✓ | ✓ | ✓ | ✓ | ✓ | ✓ |
| L3 + L31 | x | ✓ | ✓ | ✓ | ✓ | ✓ | ✓ | ✓ | ✓ | ✓ | ✓ | ✓ | ✓ | ✓ | ✓ | ✓ | ✓ |
| L3 + L32 | x | ✓ | ✓ | ✓ | ✓ | ✓ | ✓ | ✓ | ✓ | ✓ | ✓ | ✓ | ✓ | ✓ | ✓ | ✓ | ✓ |
| L4 + L5 | | x | x | | | | | | | | | | | | | | |
| L4 + L6 | | x | ✓ | x | | | | | | | | | | | | | |
| L4 + L7 | | x | ✓ | ✓ | x | | | | | | | | | | | | |
| L4 + L8 | | x | ✓ | ✓ | ✓ | x | | | | | | | | | | | |
| L4 + L9 | | x | ✓ | ✓ | ✓ | ✓ | x | | | | | | | | | | |
| L4 + L10 | | x | ✓ | ✓ | ✓ | ✓ | ✓ | x | | | | | | | | | |
| L4 + L11 | | x | ✓ | ✓ | ✓ | ✓ | ✓ | ✓ | x | | | | | | | | |
| L4 + L12 | | x | ✓ | ✓ | ✓ | ✓ | ✓ | ✓ | ✓ | x | | | | | | | |
| L4 + L13 | | x | ✓ | ✓ | ✓ | ✓ | ✓ | ✓ | ✓ | ✓ | x | | | | | | |
| L4 + L14 | | x | ✓ | ✓ | ✓ | ✓ | ✓ | ✓ | ✓ | ✓ | ✓ | x | | | | | |
| L4 + L15 | | x | ✓ | ✓ | ✓ | ✓ | ✓ | ✓ | ✓ | ✓ | ✓ | ✓ | x | | | | |
| L4 + L16 | | x | ✓ | ✓ | ✓ | ✓ | ✓ | ✓ | ✓ | ✓ | ✓ | ✓ | ✓ | x | | | |
| L4 + L17 | | x | ✓ | ✓ | ✓ | ✓ | ✓ | ✓ | ✓ | ✓ | ✓ | ✓ | ✓ | ✓ | x | | |
| L4 + L18 | | x | ✓ | ✓ | ✓ | ✓ | ✓ | ✓ | ✓ | ✓ | ✓ | ✓ | ✓ | ✓ | ✓ | x | |
| L4 + L19 | | x | ✓ | ✓ | ✓ | ✓ | ✓ | ✓ | ✓ | ✓ | ✓ | ✓ | ✓ | ✓ | ✓ | ✓ | ✓ |
| L4 + L20 | | x | ✓ | ✓ | ✓ | ✓ | ✓ | ✓ | ✓ | ✓ | ✓ | ✓ | ✓ | ✓ | ✓ | ✓ | ✓ |
| L4 + L21 | | x | ✓ | ✓ | ✓ | ✓ | ✓ | ✓ | ✓ | ✓ | ✓ | ✓ | ✓ | ✓ | ✓ | ✓ | ✓ |
| L4 + L22 | | x | ✓ | ✓ | ✓ | ✓ | ✓ | ✓ | ✓ | ✓ | ✓ | ✓ | ✓ | ✓ | ✓ | ✓ | ✓ |
| L4 + L23 | | x | ✓ | ✓ | ✓ | ✓ | ✓ | ✓ | ✓ | ✓ | ✓ | ✓ | ✓ | ✓ | ✓ | ✓ | ✓ |
| L4 + L24 | | x | ✓ | ✓ | ✓ | ✓ | ✓ | ✓ | ✓ | ✓ | ✓ | ✓ | ✓ | ✓ | ✓ | ✓ | ✓ |
| L4 + L25 | | x | ✓ | ✓ | ✓ | ✓ | ✓ | ✓ | ✓ | ✓ | ✓ | ✓ | ✓ | ✓ | ✓ | ✓ | ✓ |
| L4 + L26 | | x | ✓ | ✓ | ✓ | ✓ | ✓ | ✓ | ✓ | ✓ | ✓ | ✓ | ✓ | ✓ | ✓ | ✓ | ✓ |
| L4 + L27 | | x | ✓ | ✓ | ✓ | ✓ | ✓ | ✓ | ✓ | ✓ | ✓ | ✓ | ✓ | ✓ | ✓ | ✓ | ✓ |
| L4 + L28 | | x | ✓ | ✓ | ✓ | ✓ | ✓ | ✓ | ✓ | ✓ | ✓ | ✓ | ✓ | ✓ | ✓ | ✓ | ✓ |
| L4 + L29 | | x | ✓ | ✓ | ✓ | ✓ | ✓ | ✓ | ✓ | ✓ | ✓ | ✓ | ✓ | ✓ | ✓ | ✓ | ✓ |
| L4 + L30 | | x | ✓ | ✓ | ✓ | ✓ | ✓ | ✓ | ✓ | ✓ | ✓ | ✓ | ✓ | ✓ | ✓ | ✓ | ✓ |
| L4 + L31 | | x | ✓ | ✓ | ✓ | ✓ | ✓ | ✓ | ✓ | ✓ | ✓ | ✓ | ✓ | ✓ | ✓ | ✓ | ✓ |
| L4 + L32 | | x | ✓ | ✓ | ✓ | ✓ | ✓ | ✓ | ✓ | ✓ | ✓ | ✓ | ✓ | ✓ | ✓ | ✓ | ✓ |
| L5 + L6 | | | x | x | | | | | | | | | | | | | |
| L5 + L7 | | | x | ✓ | x | | | | | | | | | | | | |
| L5 + L8 | | | x | ✓ | ✓ | x | | | | | | | | | | | |
| L5 + L9 | | | x | ✓ | ✓ | ✓ | x | | | | | | | | | | |
| L5 + L10 | | | x | ✓ | ✓ | ✓ | ✓ | x | | | | | | | | | |
| L5 + L11 | | | x | ✓ | ✓ | ✓ | ✓ | ✓ | x | | | | | | | | |
| L5 + L12 | | | x | ✓ | ✓ | ✓ | ✓ | ✓ | ✓ | x | | | | | | | |
| L5 + L13 | | | x | ✓ | ✓ | ✓ | ✓ | ✓ | ✓ | ✓ | x | | | | | | |
| L5 + L14 | | | x | ✓ | ✓ | ✓ | ✓ | ✓ | ✓ | ✓ | ✓ | x | | | | | |
| L5 + L15 | | | x | ✓ | ✓ | ✓ | ✓ | ✓ | ✓ | ✓ | ✓ | ✓ | x | | | | |
| L5 + L16 | | | x | ✓ | ✓ | ✓ | ✓ | ✓ | ✓ | ✓ | ✓ | ✓ | ✓ | x | | | |
| L5 + L17 | | | x | ✓ | ✓ | ✓ | ✓ | ✓ | ✓ | ✓ | ✓ | ✓ | ✓ | ✓ | x | | |
| L5 + L18 | | | x | ✓ | ✓ | ✓ | ✓ | ✓ | ✓ | ✓ | ✓ | ✓ | ✓ | ✓ | ✓ | x | |
| L5 + L19 | | | x | ✓ | ✓ | ✓ | ✓ | ✓ | ✓ | ✓ | ✓ | ✓ | ✓ | ✓ | ✓ | ✓ | ✓ |
| L5 + L20 | | | x | ✓ | ✓ | ✓ | ✓ | ✓ | ✓ | ✓ | ✓ | ✓ | ✓ | ✓ | ✓ | ✓ | ✓ |
| L5 + L21 | | | x | ✓ | ✓ | ✓ | ✓ | ✓ | ✓ | ✓ | ✓ | ✓ | ✓ | ✓ | ✓ | ✓ | ✓ |
| L5 + L22 | | | x | ✓ | ✓ | ✓ | ✓ | ✓ | ✓ | ✓ | ✓ | ✓ | ✓ | ✓ | ✓ | ✓ | ✓ |
| L5 + L23 | | | x | ✓ | ✓ | ✓ | ✓ | ✓ | ✓ | ✓ | ✓ | ✓ | ✓ | ✓ | ✓ | ✓ | ✓ |
| L5 + L24 | | | x | ✓ | ✓ | ✓ | ✓ | ✓ | ✓ | ✓ | ✓ | ✓ | ✓ | ✓ | ✓ | ✓ | ✓ |
| L5 + L25 | | | x | ✓ | ✓ | ✓ | ✓ | ✓ | ✓ | ✓ | ✓ | ✓ | ✓ | ✓ | ✓ | ✓ | ✓ |
| L5 + L26 | | | x | ✓ | ✓ | ✓ | ✓ | ✓ | ✓ | ✓ | ✓ | ✓ | ✓ | ✓ | ✓ | ✓ | ✓ |
| L5 + L27 | | | x | ✓ | ✓ | ✓ | ✓ | ✓ | ✓ | ✓ | ✓ | ✓ | ✓ | ✓ | ✓ | ✓ | ✓ |

TABLE 3-continued

Modification of 3 loops

| | | | | | | | | | | | | | | | |
|---|---|---|---|---|---|---|---|---|---|---|---|---|---|---|---|
| L5 + L28 | x | ✓ | ✓ | ✓ | ✓ | ✓ | ✓ | ✓ | ✓ | ✓ | ✓ | ✓ | ✓ | ✓ | ✓ |
| L5 + L29 | x | ✓ | ✓ | ✓ | ✓ | ✓ | ✓ | ✓ | ✓ | ✓ | ✓ | ✓ | ✓ | ✓ | ✓ |
| L5 + L30 | x | ✓ | ✓ | ✓ | ✓ | ✓ | ✓ | ✓ | ✓ | ✓ | ✓ | ✓ | ✓ | ✓ | ✓ |
| L5 + L31 | x | ✓ | ✓ | ✓ | ✓ | ✓ | ✓ | ✓ | ✓ | ✓ | ✓ | ✓ | ✓ | ✓ | ✓ |
| L5 + L32 | x | ✓ | ✓ | ✓ | ✓ | ✓ | ✓ | ✓ | ✓ | ✓ | ✓ | ✓ | ✓ | ✓ | ✓ |
| L6 + L7 | | x | x | | | | | | | | | | | | |
| L6 + L8 | | x | ✓ | x | | | | | | | | | | | |
| L6 + L9 | | x | ✓ | ✓ | x | | | | | | | | | | |
| L6 + L10 | | x | ✓ | ✓ | ✓ | x | | | | | | | | | |
| L6 + L11 | | x | ✓ | ✓ | ✓ | ✓ | x | | | | | | | | |
| L6 + L12 | | x | ✓ | ✓ | ✓ | ✓ | ✓ | x | | | | | | | |
| L6 + L13 | | x | ✓ | ✓ | ✓ | ✓ | ✓ | ✓ | x | | | | | | |
| L6 + L14 | | x | ✓ | ✓ | ✓ | ✓ | ✓ | ✓ | ✓ | x | | | | | |
| L6 + L15 | | x | ✓ | ✓ | ✓ | ✓ | ✓ | ✓ | ✓ | ✓ | x | | | | |
| L6 + L16 | | x | ✓ | ✓ | ✓ | ✓ | ✓ | ✓ | ✓ | ✓ | ✓ | x | | | |
| L6 + L17 | | x | ✓ | ✓ | ✓ | ✓ | ✓ | ✓ | ✓ | ✓ | ✓ | ✓ | x | | |
| L6 + L18 | | x | ✓ | ✓ | ✓ | ✓ | ✓ | ✓ | ✓ | ✓ | ✓ | ✓ | ✓ | x | |
| L6 + L19 | | x | ✓ | ✓ | ✓ | ✓ | ✓ | ✓ | ✓ | ✓ | ✓ | ✓ | ✓ | ✓ | |
| L6 + L20 | | x | ✓ | ✓ | ✓ | ✓ | ✓ | ✓ | ✓ | ✓ | ✓ | ✓ | ✓ | ✓ | |
| L6 + L21 | | x | ✓ | ✓ | ✓ | ✓ | ✓ | ✓ | ✓ | ✓ | ✓ | ✓ | ✓ | ✓ | |
| L6 + L22 | | x | ✓ | ✓ | ✓ | ✓ | ✓ | ✓ | ✓ | ✓ | ✓ | ✓ | ✓ | ✓ | |
| L6 + L23 | | x | ✓ | ✓ | ✓ | ✓ | ✓ | ✓ | ✓ | ✓ | ✓ | ✓ | ✓ | ✓ | |
| L6 + L24 | | x | ✓ | ✓ | ✓ | ✓ | ✓ | ✓ | ✓ | ✓ | ✓ | ✓ | ✓ | ✓ | |
| L6 + L25 | | x | ✓ | ✓ | ✓ | ✓ | ✓ | ✓ | ✓ | ✓ | ✓ | ✓ | ✓ | ✓ | |
| L6 + L26 | | x | ✓ | ✓ | ✓ | ✓ | ✓ | ✓ | ✓ | ✓ | ✓ | ✓ | ✓ | ✓ | |
| L6 + L27 | | x | ✓ | ✓ | ✓ | ✓ | ✓ | ✓ | ✓ | ✓ | ✓ | ✓ | ✓ | ✓ | |
| L6 + L28 | | x | ✓ | ✓ | ✓ | ✓ | ✓ | ✓ | ✓ | ✓ | ✓ | ✓ | ✓ | ✓ | |
| L6 + L29 | | x | ✓ | ✓ | ✓ | ✓ | ✓ | ✓ | ✓ | ✓ | ✓ | ✓ | ✓ | ✓ | |
| L6 + L30 | | x | ✓ | ✓ | ✓ | ✓ | ✓ | ✓ | ✓ | ✓ | ✓ | ✓ | ✓ | ✓ | |
| L6 + L31 | | x | ✓ | ✓ | ✓ | ✓ | ✓ | ✓ | ✓ | ✓ | ✓ | ✓ | ✓ | ✓ | |
| L6 + L32 | | x | ✓ | ✓ | ✓ | ✓ | ✓ | ✓ | ✓ | ✓ | ✓ | ✓ | ✓ | ✓ | |
| L7 + L8 | | | x | x | | | | | | | | | | | |
| L7 + L9 | | | x | ✓ | x | | | | | | | | | | |
| L7 + L10 | | | x | ✓ | ✓ | x | | | | | | | | | |
| L7 + L11 | | | x | ✓ | ✓ | ✓ | x | | | | | | | | |
| L7 + L12 | | | x | ✓ | ✓ | ✓ | ✓ | x | | | | | | | |
| L7 + L13 | | | x | ✓ | ✓ | ✓ | ✓ | ✓ | x | | | | | | |
| L7 + L14 | | | x | ✓ | ✓ | ✓ | ✓ | ✓ | ✓ | x | | | | | |
| L7 + L15 | | | x | ✓ | ✓ | ✓ | ✓ | ✓ | ✓ | ✓ | x | | | | |
| L7 + L16 | | | x | ✓ | ✓ | ✓ | ✓ | ✓ | ✓ | ✓ | ✓ | x | | | |
| L7 + L17 | | | x | ✓ | ✓ | ✓ | ✓ | ✓ | ✓ | ✓ | ✓ | ✓ | x | | |
| L7 + L18 | | | x | ✓ | ✓ | ✓ | ✓ | ✓ | ✓ | ✓ | ✓ | ✓ | ✓ | x | |
| L7 + L19 | | | x | ✓ | ✓ | ✓ | ✓ | ✓ | ✓ | ✓ | ✓ | ✓ | ✓ | ✓ | |
| L7 + L20 | | | x | ✓ | ✓ | ✓ | ✓ | ✓ | ✓ | ✓ | ✓ | ✓ | ✓ | ✓ | |
| L7 + L21 | | | x | ✓ | ✓ | ✓ | ✓ | ✓ | ✓ | ✓ | ✓ | ✓ | ✓ | ✓ | |
| L7 + L22 | | | x | ✓ | ✓ | ✓ | ✓ | ✓ | ✓ | ✓ | ✓ | ✓ | ✓ | ✓ | |
| L7 + L23 | | | x | ✓ | ✓ | ✓ | ✓ | ✓ | ✓ | ✓ | ✓ | ✓ | ✓ | ✓ | |
| L7 + L24 | | | x | ✓ | ✓ | ✓ | ✓ | ✓ | ✓ | ✓ | ✓ | ✓ | ✓ | ✓ | |
| L7 + L25 | | | x | ✓ | ✓ | ✓ | ✓ | ✓ | ✓ | ✓ | ✓ | ✓ | ✓ | ✓ | |
| L7 + L26 | | | x | ✓ | ✓ | ✓ | ✓ | ✓ | ✓ | ✓ | ✓ | ✓ | ✓ | ✓ | |
| L7 + L27 | | | x | ✓ | ✓ | ✓ | ✓ | ✓ | ✓ | ✓ | ✓ | ✓ | ✓ | ✓ | |
| L7 + L28 | | | x | ✓ | ✓ | ✓ | ✓ | ✓ | ✓ | ✓ | ✓ | ✓ | ✓ | ✓ | |
| L7 + L29 | | | x | ✓ | ✓ | ✓ | ✓ | ✓ | ✓ | ✓ | ✓ | ✓ | ✓ | ✓ | |
| L7 + L30 | | | x | ✓ | ✓ | ✓ | ✓ | ✓ | ✓ | ✓ | ✓ | ✓ | ✓ | ✓ | |
| L7 + L31 | | | x | ✓ | ✓ | ✓ | ✓ | ✓ | ✓ | ✓ | ✓ | ✓ | ✓ | ✓ | |
| L7 + L32 | | | x | ✓ | ✓ | ✓ | ✓ | ✓ | ✓ | ✓ | ✓ | ✓ | ✓ | ✓ | |
| L8 + L9 | | | | x | x | | | | | | | | | | |
| L8 + L10 | | | | x | ✓ | x | | | | | | | | | |
| L8 + L11 | | | | x | ✓ | ✓ | x | | | | | | | | |
| L8 + L12 | | | | x | ✓ | ✓ | ✓ | x | | | | | | | |
| L8 + L13 | | | | x | ✓ | ✓ | ✓ | ✓ | x | | | | | | |
| L8 + L14 | | | | x | ✓ | ✓ | ✓ | ✓ | ✓ | x | | | | | |
| L8 + L15 | | | | x | ✓ | ✓ | ✓ | ✓ | ✓ | ✓ | x | | | | |
| L8 + L16 | | | | x | ✓ | ✓ | ✓ | ✓ | ✓ | ✓ | ✓ | x | | | |
| L8 + L17 | | | | x | ✓ | ✓ | ✓ | ✓ | ✓ | ✓ | ✓ | ✓ | x | | |
| L8 + L18 | | | | x | ✓ | ✓ | ✓ | ✓ | ✓ | ✓ | ✓ | ✓ | ✓ | x | |
| L8 + L19 | | | | x | ✓ | ✓ | ✓ | ✓ | ✓ | ✓ | ✓ | ✓ | ✓ | ✓ | |
| L8 + L20 | | | | x | ✓ | ✓ | ✓ | ✓ | ✓ | ✓ | ✓ | ✓ | ✓ | ✓ | |
| L8 + L21 | | | | x | ✓ | ✓ | ✓ | ✓ | ✓ | ✓ | ✓ | ✓ | ✓ | ✓ | |
| L8 + L22 | | | | x | ✓ | ✓ | ✓ | ✓ | ✓ | ✓ | ✓ | ✓ | ✓ | ✓ | |
| L8 + L23 | | | | x | ✓ | ✓ | ✓ | ✓ | ✓ | ✓ | ✓ | ✓ | ✓ | ✓ | |
| L8 + L24 | | | | x | ✓ | ✓ | ✓ | ✓ | ✓ | ✓ | ✓ | ✓ | ✓ | ✓ | |
| L8 + L25 | | | | x | ✓ | ✓ | ✓ | ✓ | ✓ | ✓ | ✓ | ✓ | ✓ | ✓ | |
| L8 + L26 | | | | x | ✓ | ✓ | ✓ | ✓ | ✓ | ✓ | ✓ | ✓ | ✓ | ✓ | |
| L8 + L27 | | | | x | ✓ | ✓ | ✓ | ✓ | ✓ | ✓ | ✓ | ✓ | ✓ | ✓ | |
| L8 + L28 | | | | x | ✓ | ✓ | ✓ | ✓ | ✓ | ✓ | ✓ | ✓ | ✓ | ✓ | |
| L8 + L29 | | | | x | ✓ | ✓ | ✓ | ✓ | ✓ | ✓ | ✓ | ✓ | ✓ | ✓ | |
| L8 + L30 | | | | x | ✓ | ✓ | ✓ | ✓ | ✓ | ✓ | ✓ | ✓ | ✓ | ✓ | |

TABLE 3-continued

| Modification of 3 loops | | | | | | | | | | | |
|---|---|---|---|---|---|---|---|---|---|---|---|
| L8 + L31 | x | ✓ | ✓ | ✓ | ✓ | ✓ | ✓ | ✓ | ✓ | ✓ | ✓ |
| L8 + L32 | x | ✓ | ✓ | ✓ | ✓ | ✓ | ✓ | ✓ | ✓ | ✓ | ✓ |
| L9 + L10 |   | x | x |   |   |   |   |   |   |   |   |
| L9 + L11 |   | x | ✓ | x |   |   |   |   |   |   |   |
| L9 + L12 |   | x | ✓ | ✓ | x |   |   |   |   |   |   |
| L9 + L13 |   | x | ✓ | ✓ | ✓ | x |   |   |   |   |   |
| L9 + L14 |   | x | ✓ | ✓ | ✓ | ✓ | x |   |   |   |   |
| L9 + L15 |   | x | ✓ | ✓ | ✓ | ✓ | ✓ | x |   |   |   |
| L9 + L16 |   | x | ✓ | ✓ | ✓ | ✓ | ✓ | ✓ | x |   |   |
| L9 + L17 |   | x | ✓ | ✓ | ✓ | ✓ | ✓ | ✓ | ✓ | x |   |
| L9 + L18 |   | x | ✓ | ✓ | ✓ | ✓ | ✓ | ✓ | ✓ | ✓ | x |
| L9 + L19 |   | x | ✓ | ✓ | ✓ | ✓ | ✓ | ✓ | ✓ | ✓ | ✓ |
| L9 + L20 |   | x | ✓ | ✓ | ✓ | ✓ | ✓ | ✓ | ✓ | ✓ | ✓ |
| L9 + L21 |   | x | ✓ | ✓ | ✓ | ✓ | ✓ | ✓ | ✓ | ✓ | ✓ |
| L9 + L22 |   | x | ✓ | ✓ | ✓ | ✓ | ✓ | ✓ | ✓ | ✓ | ✓ |
| L9 + L23 |   | x | ✓ | ✓ | ✓ | ✓ | ✓ | ✓ | ✓ | ✓ | ✓ |
| L9 + L24 |   | x | ✓ | ✓ | ✓ | ✓ | ✓ | ✓ | ✓ | ✓ | ✓ |
| L9 + L25 |   | x | ✓ | ✓ | ✓ | ✓ | ✓ | ✓ | ✓ | ✓ | ✓ |
| L9 + L26 |   | x | ✓ | ✓ | ✓ | ✓ | ✓ | ✓ | ✓ | ✓ | ✓ |
| L9 + L27 |   | x | ✓ | ✓ | ✓ | ✓ | ✓ | ✓ | ✓ | ✓ | ✓ |
| L9 + L28 |   | x | ✓ | ✓ | ✓ | ✓ | ✓ | ✓ | ✓ | ✓ | ✓ |
| L9 + L29 |   | x | ✓ | ✓ | ✓ | ✓ | ✓ | ✓ | ✓ | ✓ | ✓ |
| L9 + L30 |   | x | ✓ | ✓ | ✓ | ✓ | ✓ | ✓ | ✓ | ✓ | ✓ |
| L9 + L31 |   | x | ✓ | ✓ | ✓ | ✓ | ✓ | ✓ | ✓ | ✓ | ✓ |
| L9 + L32 |   | x | ✓ | ✓ | ✓ | ✓ | ✓ | ✓ | ✓ | ✓ | ✓ |
| L10 + L11 |   |   | x | x |   |   |   |   |   |   |   |
| L10 + L12 |   |   | x | ✓ | x |   |   |   |   |   |   |
| L10 + L13 |   |   | x | ✓ | ✓ | x |   |   |   |   |   |
| L10 + L14 |   |   | x | ✓ | ✓ | ✓ | x |   |   |   |   |
| L10 + L15 |   |   | x | ✓ | ✓ | ✓ | ✓ | x |   |   |   |
| L10 + L16 |   |   | x | ✓ | ✓ | ✓ | ✓ | ✓ | x |   |   |
| L10 + L17 |   |   | x | ✓ | ✓ | ✓ | ✓ | ✓ | ✓ | x |   |
| L10 + L18 |   |   | x | ✓ | ✓ | ✓ | ✓ | ✓ | ✓ | ✓ | x |
| L10 + L19 |   |   | x | ✓ | ✓ | ✓ | ✓ | ✓ | ✓ | ✓ | ✓ |
| L10 + L20 |   |   | x | ✓ | ✓ | ✓ | ✓ | ✓ | ✓ | ✓ | ✓ |
| L10 + L21 |   |   | x | ✓ | ✓ | ✓ | ✓ | ✓ | ✓ | ✓ | ✓ |
| L10 + L22 |   |   | x | ✓ | ✓ | ✓ | ✓ | ✓ | ✓ | ✓ | ✓ |
| L10 + L23 |   |   | x | ✓ | ✓ | ✓ | ✓ | ✓ | ✓ | ✓ | ✓ |
| L10 + L24 |   |   | x | ✓ | ✓ | ✓ | ✓ | ✓ | ✓ | ✓ | ✓ |
| L10 + L25 |   |   | x | ✓ | ✓ | ✓ | ✓ | ✓ | ✓ | ✓ | ✓ |
| L10 + L26 |   |   | x | ✓ | ✓ | ✓ | ✓ | ✓ | ✓ | ✓ | ✓ |
| L10 + L27 |   |   | x | ✓ | ✓ | ✓ | ✓ | ✓ | ✓ | ✓ | ✓ |
| L10 + L28 |   |   | x | ✓ | ✓ | ✓ | ✓ | ✓ | ✓ | ✓ | ✓ |
| L10 + L29 |   |   | x | ✓ | ✓ | ✓ | ✓ | ✓ | ✓ | ✓ | ✓ |
| L10 + L30 |   |   | x | ✓ | ✓ | ✓ | ✓ | ✓ | ✓ | ✓ | ✓ |
| L10 + L31 |   |   | x | ✓ | ✓ | ✓ | ✓ | ✓ | ✓ | ✓ | ✓ |
| L10 + L32 |   |   | x | ✓ | ✓ | ✓ | ✓ | ✓ | ✓ | ✓ | ✓ |
| L11 + L12 |   |   |   | x | x |   |   |   |   |   |   |
| L11 + L13 |   |   |   | x | ✓ | x |   |   |   |   |   |
| L11 + L14 |   |   |   | x | ✓ | ✓ | x |   |   |   |   |
| L11 + L15 |   |   |   | x | ✓ | ✓ | ✓ | x |   |   |   |
| L11 + L16 |   |   |   | x | ✓ | ✓ | ✓ | ✓ | x |   |   |
| L11 + L17 |   |   |   | x | ✓ | ✓ | ✓ | ✓ | ✓ | x |   |
| L11 + L18 |   |   |   | x | ✓ | ✓ | ✓ | ✓ | ✓ | ✓ | x |
| L11 + L19 |   |   |   | x | ✓ | ✓ | ✓ | ✓ | ✓ | ✓ | ✓ |
| L11 + L20 |   |   |   | x | ✓ | ✓ | ✓ | ✓ | ✓ | ✓ | ✓ |
| L11 + L21 |   |   |   | x | ✓ | ✓ | ✓ | ✓ | ✓ | ✓ | ✓ |
| L11 + L22 |   |   |   | x | ✓ | ✓ | ✓ | ✓ | ✓ | ✓ | ✓ |
| L11 + L23 |   |   |   | x | ✓ | ✓ | ✓ | ✓ | ✓ | ✓ | ✓ |
| L11 + L24 |   |   |   | x | ✓ | ✓ | ✓ | ✓ | ✓ | ✓ | ✓ |
| L11 + L25 |   |   |   | x | ✓ | ✓ | ✓ | ✓ | ✓ | ✓ | ✓ |
| L11 + L26 |   |   |   | x | ✓ | ✓ | ✓ | ✓ | ✓ | ✓ | ✓ |
| L11 + L27 |   |   |   | x | ✓ | ✓ | ✓ | ✓ | ✓ | ✓ | ✓ |
| L11 + L28 |   |   |   | x | ✓ | ✓ | ✓ | ✓ | ✓ | ✓ | ✓ |
| L11 + L29 |   |   |   | x | ✓ | ✓ | ✓ | ✓ | ✓ | ✓ | ✓ |
| L11 + L30 |   |   |   | x | ✓ | ✓ | ✓ | ✓ | ✓ | ✓ | ✓ |
| L11 + L31 |   |   |   | x | ✓ | ✓ | ✓ | ✓ | ✓ | ✓ | ✓ |
| L11 + L32 |   |   |   | x | ✓ | ✓ | ✓ | ✓ | ✓ | ✓ | ✓ |
| L12 + L13 |   |   |   |   | x | x |   |   |   |   |   |
| L12 + L14 |   |   |   |   | x | ✓ | x |   |   |   |   |
| L12 + L15 |   |   |   |   | x | ✓ | ✓ | x |   |   |   |
| L12 + L16 |   |   |   |   | x | ✓ | ✓ | ✓ | x |   |   |
| L12 + L17 |   |   |   |   | x | ✓ | ✓ | ✓ | ✓ | x |   |
| L12 + L18 |   |   |   |   | x | ✓ | ✓ | ✓ | ✓ | ✓ | x |
| L12 + L19 |   |   |   |   | x | ✓ | ✓ | ✓ | ✓ | ✓ | ✓ |
| L12 + L20 |   |   |   |   | x | ✓ | ✓ | ✓ | ✓ | ✓ | ✓ |
| L12 + L21 |   |   |   |   | x | ✓ | ✓ | ✓ | ✓ | ✓ | ✓ |
| L12 + L22 |   |   |   |   | x | ✓ | ✓ | ✓ | ✓ | ✓ | ✓ |

TABLE 3-continued

| | | | Modification of 3 loops | | | | | |
|---|---|---|---|---|---|---|---|---|
| L12 + L23 | x | ✓ | ✓ | ✓ | ✓ | ✓ | ✓ | ✓ |
| L12 + L24 | x | ✓ | ✓ | ✓ | ✓ | ✓ | ✓ | ✓ |
| L12 + L25 | x | ✓ | ✓ | ✓ | ✓ | ✓ | ✓ | ✓ |
| L12 + L26 | x | ✓ | ✓ | ✓ | ✓ | ✓ | ✓ | ✓ |
| L12 + L27 | x | ✓ | ✓ | ✓ | ✓ | ✓ | ✓ | ✓ |
| L12 + L28 | x | ✓ | ✓ | ✓ | ✓ | ✓ | ✓ | ✓ |
| L12 + L29 | x | ✓ | ✓ | ✓ | ✓ | ✓ | ✓ | ✓ |
| L12 + L30 | x | ✓ | ✓ | ✓ | ✓ | ✓ | ✓ | ✓ |
| L12 + L31 | x | ✓ | ✓ | ✓ | ✓ | ✓ | ✓ | ✓ |
| L12 + L32 | x | ✓ | ✓ | ✓ | ✓ | ✓ | ✓ | ✓ |
| L13 + L14 | | x | x | | | | | |
| L13 + L15 | | x | ✓ | x | | | | |
| L13 + L16 | | x | ✓ | ✓ | x | | | |
| L13 + L17 | | x | ✓ | ✓ | ✓ | x | | |
| L13 + L18 | | x | ✓ | ✓ | ✓ | ✓ | x | |
| L13 + L19 | | x | ✓ | ✓ | ✓ | ✓ | ✓ | x |
| L13 + L20 | | x | ✓ | ✓ | ✓ | ✓ | ✓ | ✓ |
| L13 + L21 | | x | ✓ | ✓ | ✓ | ✓ | ✓ | ✓ |
| L13 + L22 | | x | ✓ | ✓ | ✓ | ✓ | ✓ | ✓ |
| L13 + L23 | | x | ✓ | ✓ | ✓ | ✓ | ✓ | ✓ |
| L13 + L24 | | x | ✓ | ✓ | ✓ | ✓ | ✓ | ✓ |
| L13 + L25 | | x | ✓ | ✓ | ✓ | ✓ | ✓ | ✓ |
| L13 + L26 | | x | ✓ | ✓ | ✓ | ✓ | ✓ | ✓ |
| L13 + L27 | | x | ✓ | ✓ | ✓ | ✓ | ✓ | ✓ |
| L13 + L28 | | x | ✓ | ✓ | ✓ | ✓ | ✓ | ✓ |
| L13 + L29 | | x | ✓ | ✓ | ✓ | ✓ | ✓ | ✓ |
| L13 + L30 | | x | ✓ | ✓ | ✓ | ✓ | ✓ | ✓ |
| L13 + L31 | | x | ✓ | ✓ | ✓ | ✓ | ✓ | ✓ |
| L13 + L32 | | x | ✓ | ✓ | ✓ | ✓ | ✓ | ✓ |
| L14 + L15 | | | x | x | | | | |
| L14 + L16 | | | x | ✓ | x | | | |
| L14 + L17 | | | x | ✓ | ✓ | x | | |
| L14 + L18 | | | x | ✓ | ✓ | ✓ | x | |
| L14 + L19 | | | x | ✓ | ✓ | ✓ | ✓ | x |
| L14 + L20 | | | x | ✓ | ✓ | ✓ | ✓ | ✓ |
| L14 + L21 | | | x | ✓ | ✓ | ✓ | ✓ | ✓ |
| L14 + L22 | | | x | ✓ | ✓ | ✓ | ✓ | ✓ |
| L14 + L23 | | | x | ✓ | ✓ | ✓ | ✓ | ✓ |
| L14 + L24 | | | x | ✓ | ✓ | ✓ | ✓ | ✓ |
| L14 + L25 | | | x | ✓ | ✓ | ✓ | ✓ | ✓ |
| L14 + L26 | | | x | ✓ | ✓ | ✓ | ✓ | ✓ |
| L14 + L27 | | | x | ✓ | ✓ | ✓ | ✓ | ✓ |
| L14 + L28 | | | x | ✓ | ✓ | ✓ | ✓ | ✓ |
| L14 + L29 | | | x | ✓ | ✓ | ✓ | ✓ | ✓ |
| L14 + L30 | | | x | ✓ | ✓ | ✓ | ✓ | ✓ |
| L14 + L31 | | | x | ✓ | ✓ | ✓ | ✓ | ✓ |
| L14 + L32 | | | x | ✓ | ✓ | ✓ | ✓ | ✓ |
| L15 + L16 | | | | x | x | | | |
| L15 + L17 | | | | x | ✓ | x | | |
| L15 + L18 | | | | x | ✓ | ✓ | x | |
| L15 + L19 | | | | x | ✓ | ✓ | ✓ | x |
| L15 + L20 | | | | x | ✓ | ✓ | ✓ | ✓ |
| L15 + L21 | | | | x | ✓ | ✓ | ✓ | ✓ |
| L15 + L22 | | | | x | ✓ | ✓ | ✓ | ✓ |
| L15 + L23 | | | | x | ✓ | ✓ | ✓ | ✓ |
| L15 + L24 | | | | x | ✓ | ✓ | ✓ | ✓ |
| L15 + L25 | | | | x | ✓ | ✓ | ✓ | ✓ |
| L15 + L26 | | | | x | ✓ | ✓ | ✓ | ✓ |
| L15 + L27 | | | | x | ✓ | ✓ | ✓ | ✓ |
| L15 + L28 | | | | x | ✓ | ✓ | ✓ | ✓ |
| L15 + L29 | | | | x | ✓ | ✓ | ✓ | ✓ |
| L15 + L30 | | | | x | ✓ | ✓ | ✓ | ✓ |
| L15 + L31 | | | | x | ✓ | ✓ | ✓ | ✓ |
| L15 + L32 | | | | x | ✓ | ✓ | ✓ | ✓ |
| L16 + L17 | | | | | x | x | | |
| L16 + L18 | | | | | x | ✓ | x | |
| L16 + L19 | | | | | x | ✓ | ✓ | x |
| L16 + L20 | | | | | x | ✓ | ✓ | ✓ |
| L16 + L21 | | | | | x | ✓ | ✓ | ✓ |
| L16 + L22 | | | | | x | ✓ | ✓ | ✓ |
| L16 + L23 | | | | | x | ✓ | ✓ | ✓ |
| L16 + L24 | | | | | x | ✓ | ✓ | ✓ |
| L16 + L25 | | | | | x | ✓ | ✓ | ✓ |
| L16 + L26 | | | | | x | ✓ | ✓ | ✓ |
| L16 + L27 | | | | | x | ✓ | ✓ | ✓ |
| L16 + L28 | | | | | x | ✓ | ✓ | ✓ |
| L16 + L29 | | | | | x | ✓ | ✓ | ✓ |
| L16 + L30 | | | | | x | ✓ | ✓ | ✓ |

TABLE 3-continued

| Modification of 3 loops | | | |
|---|---|---|---|
| L16 + L31 | x | ✓ | ✓ |
| L16 + L32 | x | ✓ | ✓ |
| L17 + L18 |  | x | x |
| L17 + L19 |  | x | ✓ |
| L17 + L20 |  | x | ✓ |
| L17 + L21 |  | x | ✓ |
| L17 + L22 |  | x | ✓ |
| L17 + L23 |  | x | ✓ |
| L17 + L24 |  | x | ✓ |
| L17 + L25 |  | x | ✓ |
| L17 + L26 |  | x | ✓ |
| L17 + L27 |  | x | ✓ |
| L17 + L28 |  | x | ✓ |
| L17 + L29 |  | x | ✓ |
| L17 + L30 |  | x | ✓ |
| L17 + L31 |  | x | ✓ |
| L17 + L32 |  | x | ✓ |
| L18 + L19 |  |  | x |
| L18 + L20 |  |  | x |
| L18 + L21 |  |  | x |
| L18 + L22 |  |  | x |
| L18 + L23 |  |  | x |
| L18 + L24 |  |  | x |
| L18 + L25 |  |  | x |
| L18 + L26 |  |  | x |
| L18 + L27 |  |  | x |
| L18 + L28 |  |  | x |
| L18 + L29 |  |  | x |
| L18 + L30 |  |  | x |
| L18 + L31 |  |  | x |
| L18 + L32 |  |  | x |
| L19 + L20 |  |  |  |
| L19 + L21 |  |  |  |
| L19 + L22 |  |  |  |
| L19 + L23 |  |  |  |
| L19 + L24 |  |  |  |
| L19 + L25 |  |  |  |
| L19 + L26 |  |  |  |
| L19 + L27 |  |  |  |
| L19 + L28 |  |  |  |
| L19 + L29 |  |  |  |
| L19 + L30 |  |  |  |
| L19 + L31 |  |  |  |
| L19 + L32 |  |  |  |
| L20 + L21 |  |  |  |
| L20 + L22 |  |  |  |
| L20 + L23 |  |  |  |
| L20 + L24 |  |  |  |
| L20 + L25 |  |  |  |
| L20 + L26 |  |  |  |
| L20 + L27 |  |  |  |
| L20 + L28 |  |  |  |
| L20 + L29 |  |  |  |
| L20 + L30 |  |  |  |
| L20 + L31 |  |  |  |
| L20 + L32 |  |  |  |
| L21 + L22 |  |  |  |
| L21 + L23 |  |  |  |
| L21 + L24 |  |  |  |
| L21 + L25 |  |  |  |
| L21 + L26 |  |  |  |
| L21 + L27 |  |  |  |
| L21 + L28 |  |  |  |
| L21 + L29 |  |  |  |
| L21 + L30 |  |  |  |
| L21 + L31 |  |  |  |
| L21 + L32 |  |  |  |
| L22 + L23 |  |  |  |
| L22 + L24 |  |  |  |
| L22 + L25 |  |  |  |
| L22 + L26 |  |  |  |
| L22 + L27 |  |  |  |
| L22 + L28 |  |  |  |
| L22 + L29 |  |  |  |
| L22 + L30 |  |  |  |
| L22 + L31 |  |  |  |
| L22 + L32 |  |  |  |
| L23 + L24 |  |  |  |

TABLE 3-continued

Modification of 3 loops

L23 + L25
L23 + L26
L23 + L27
L23 + L28
L23 + L29
L23 + L30
L23 + L31
L23 + L32
L24 + L25
L24 + L26
L24 + L27
L24 + L28
L24 + L29
L24 + L30
L24 + L31
L24 + L32
L25 + L26
L25 + L27
L25 + L28
L25 + L29
L25 + L30
L25 + L31
L25 + L32
L26 + L27
L26 + L28
L26 + L29
L26 + L30
L26 + L31
L26 + L32
L27 + L28
L27 + L29
L27 + L30
L27 + L31
L27 + L32
L28 + L29
L28 + L30
L28 + L31
L28 + L32
L29 + L30
L29 + L31
L29 + L32
L30 + L31
L30 + L32
L31 + L32

|         | L19 | L20 | L21 | L22 | L23 | L24 | L25 | L26 | L27 | L28 | L29 | L30 | L31 | L32 |
|---------|-----|-----|-----|-----|-----|-----|-----|-----|-----|-----|-----|-----|-----|-----|
| L1 + L2 |     |     |     |     |     |     |     |     |     |     |     |     |     |     |
| L1 + L3 |     |     |     |     |     |     |     |     |     |     |     |     |     |     |
| L1 + L4 |     |     |     |     |     |     |     |     |     |     |     |     |     |     |
| L1 + L5 |     |     |     |     |     |     |     |     |     |     |     |     |     |     |
| L1 + L6 |     |     |     |     |     |     |     |     |     |     |     |     |     |     |
| L1 + L7 |     |     |     |     |     |     |     |     |     |     |     |     |     |     |
| L1 + L8 |     |     |     |     |     |     |     |     |     |     |     |     |     |     |
| L1 + L9 |     |     |     |     |     |     |     |     |     |     |     |     |     |     |
| L1 + L10 |    |     |     |     |     |     |     |     |     |     |     |     |     |     |
| L1 + L11 |    |     |     |     |     |     |     |     |     |     |     |     |     |     |
| L1 + L12 |    |     |     |     |     |     |     |     |     |     |     |     |     |     |
| L1 + L13 |    |     |     |     |     |     |     |     |     |     |     |     |     |     |
| L1 + L14 |    |     |     |     |     |     |     |     |     |     |     |     |     |     |
| L1 + L15 |    |     |     |     |     |     |     |     |     |     |     |     |     |     |
| L1 + L16 |    |     |     |     |     |     |     |     |     |     |     |     |     |     |
| L1 + L17 |    |     |     |     |     |     |     |     |     |     |     |     |     |     |
| L1 + L18 |    |     |     |     |     |     |     |     |     |     |     |     |     |     |
| L1 + L19 | x  |     |     |     |     |     |     |     |     |     |     |     |     |     |
| L1 + L20 | ✓  | x   |     |     |     |     |     |     |     |     |     |     |     |     |
| L1 + L21 | ✓  | ✓   | x   |     |     |     |     |     |     |     |     |     |     |     |
| L1 + L22 | ✓  | ✓   | ✓   | x   |     |     |     |     |     |     |     |     |     |     |
| L1 + L23 | ✓  | ✓   | ✓   | ✓   | x   |     |     |     |     |     |     |     |     |     |
| L1 + L24 | ✓  | ✓   | ✓   | ✓   | ✓   | x   |     |     |     |     |     |     |     |     |
| L1 + L25 | ✓  | ✓   | ✓   | ✓   | ✓   | ✓   | x   |     |     |     |     |     |     |     |
| L1 + L26 | ✓  | ✓   | ✓   | ✓   | ✓   | ✓   | ✓   | x   |     |     |     |     |     |     |
| L1 + L27 | ✓  | ✓   | ✓   | ✓   | ✓   | ✓   | ✓   | ✓   | x   |     |     |     |     |     |
| L1 + L28 | ✓  | ✓   | ✓   | ✓   | ✓   | ✓   | ✓   | ✓   | ✓   | x   |     |     |     |     |
| L1 + L29 | ✓  | ✓   | ✓   | ✓   | ✓   | ✓   | ✓   | ✓   | ✓   | ✓   | x   |     |     |     |
| L1 + L30 | ✓  | ✓   | ✓   | ✓   | ✓   | ✓   | ✓   | ✓   | ✓   | ✓   | ✓   | x   |     |     |
| L1 + L31 | ✓  | ✓   | ✓   | ✓   | ✓   | ✓   | ✓   | ✓   | ✓   | ✓   | ✓   | ✓   | x   |     |
| L1 + L32 | ✓  | ✓   | ✓   | ✓   | ✓   | ✓   | ✓   | ✓   | ✓   | ✓   | ✓   | ✓   | ✓   | x   |

TABLE 3-continued

| Modification of 3 loops | | | | | | | | | | | | | | |
|---|---|---|---|---|---|---|---|---|---|---|---|---|---|---|
| L2 + L3 | | | | | | | | | | | | | | |
| L2 + L4 | | | | | | | | | | | | | | |
| L2 + L3 | | | | | | | | | | | | | | |
| L2 + L6 | | | | | | | | | | | | | | |
| L2 + L7 | | | | | | | | | | | | | | |
| L2 + L8 | | | | | | | | | | | | | | |
| L2 + L9 | | | | | | | | | | | | | | |
| L2 + L10 | | | | | | | | | | | | | | |
| L2 + L11 | | | | | | | | | | | | | | |
| L2 + L12 | | | | | | | | | | | | | | |
| L2 + L13 | | | | | | | | | | | | | | |
| L2 + L14 | | | | | | | | | | | | | | |
| L2 + L15 | | | | | | | | | | | | | | |
| L2 + L16 | | | | | | | | | | | | | | |
| L2 + L17 | | | | | | | | | | | | | | |
| L2 + L18 | | | | | | | | | | | | | | |
| L2 + L19 | x | | | | | | | | | | | | | |
| L2 + L20 | ✓ | x | | | | | | | | | | | | |
| L2 + L21 | ✓ | ✓ | x | | | | | | | | | | | |
| L2 + L22 | ✓ | ✓ | ✓ | x | | | | | | | | | | |
| L2 + L23 | ✓ | ✓ | ✓ | ✓ | x | | | | | | | | | |
| L2 + L24 | ✓ | ✓ | ✓ | ✓ | ✓ | x | | | | | | | | |
| L2 + L25 | ✓ | ✓ | ✓ | ✓ | ✓ | ✓ | x | | | | | | | |
| L2 + L26 | ✓ | ✓ | ✓ | ✓ | ✓ | ✓ | ✓ | x | | | | | | |
| L2 + L27 | ✓ | ✓ | ✓ | ✓ | ✓ | ✓ | ✓ | ✓ | x | | | | | |
| L2 + L28 | ✓ | ✓ | ✓ | ✓ | ✓ | ✓ | ✓ | ✓ | ✓ | x | | | | |
| L2 + L29 | ✓ | ✓ | ✓ | ✓ | ✓ | ✓ | ✓ | ✓ | ✓ | ✓ | x | | | |
| L2 + L30 | ✓ | ✓ | ✓ | ✓ | ✓ | ✓ | ✓ | ✓ | ✓ | ✓ | ✓ | x | | |
| L2 + L31 | ✓ | ✓ | ✓ | ✓ | ✓ | ✓ | ✓ | ✓ | ✓ | ✓ | ✓ | ✓ | x | |
| L2 + L32 | ✓ | ✓ | ✓ | ✓ | ✓ | ✓ | ✓ | ✓ | ✓ | ✓ | ✓ | ✓ | ✓ | x |
| L3 + L4 | | | | | | | | | | | | | | |
| L3 + L5 | | | | | | | | | | | | | | |
| L3 + L6 | | | | | | | | | | | | | | |
| L3 + L7 | | | | | | | | | | | | | | |
| L3 + L8 | | | | | | | | | | | | | | |
| L3 + L9 | | | | | | | | | | | | | | |
| L3 + L10 | | | | | | | | | | | | | | |
| L3 + L11 | | | | | | | | | | | | | | |
| L3 + L12 | | | | | | | | | | | | | | |
| L3 + L13 | | | | | | | | | | | | | | |
| L3 + L14 | | | | | | | | | | | | | | |
| L3 + L15 | | | | | | | | | | | | | | |
| L3 + L16 | | | | | | | | | | | | | | |
| L3 + L17 | | | | | | | | | | | | | | |
| L3 + L18 | | | | | | | | | | | | | | |
| L3 + L19 | x | | | | | | | | | | | | | |
| L3 + L20 | ✓ | x | | | | | | | | | | | | |
| L3 + L21 | ✓ | ✓ | x | | | | | | | | | | | |
| L3 + L22 | ✓ | ✓ | ✓ | x | | | | | | | | | | |
| L3 + L23 | ✓ | ✓ | ✓ | ✓ | x | | | | | | | | | |
| L3 + L24 | ✓ | ✓ | ✓ | ✓ | ✓ | x | | | | | | | | |
| L3 + L25 | ✓ | ✓ | ✓ | ✓ | ✓ | ✓ | x | | | | | | | |
| L3 + L26 | ✓ | ✓ | ✓ | ✓ | ✓ | ✓ | ✓ | x | | | | | | |
| L3 + L27 | ✓ | ✓ | ✓ | ✓ | ✓ | ✓ | ✓ | ✓ | x | | | | | |
| L3 + L28 | ✓ | ✓ | ✓ | ✓ | ✓ | ✓ | ✓ | ✓ | ✓ | x | | | | |
| L3 + L29 | ✓ | ✓ | ✓ | ✓ | ✓ | ✓ | ✓ | ✓ | ✓ | ✓ | x | | | |
| L3 + L30 | ✓ | ✓ | ✓ | ✓ | ✓ | ✓ | ✓ | ✓ | ✓ | ✓ | ✓ | x | | |
| L3 + L31 | ✓ | ✓ | ✓ | ✓ | ✓ | ✓ | ✓ | ✓ | ✓ | ✓ | ✓ | ✓ | x | |
| L3 + L32 | ✓ | ✓ | ✓ | ✓ | ✓ | ✓ | ✓ | ✓ | ✓ | ✓ | ✓ | ✓ | ✓ | x |
| L4 + L5 | | | | | | | | | | | | | | |
| L4 + L6 | | | | | | | | | | | | | | |
| L4 + L7 | | | | | | | | | | | | | | |
| L4 + L8 | | | | | | | | | | | | | | |
| L4 + L9 | | | | | | | | | | | | | | |
| L4 + L10 | | | | | | | | | | | | | | |
| L4 + L11 | | | | | | | | | | | | | | |
| L4 + L12 | | | | | | | | | | | | | | |
| L4 + L13 | | | | | | | | | | | | | | |
| L4 + L14 | | | | | | | | | | | | | | |
| L4 + L15 | | | | | | | | | | | | | | |
| L4 + L16 | | | | | | | | | | | | | | |
| L4 + L17 | | | | | | | | | | | | | | |
| L4 + L18 | | | | | | | | | | | | | | |
| L4 + L19 | x | | | | | | | | | | | | | |
| L4 + L20 | ✓ | x | | | | | | | | | | | | |
| L4 + L21 | ✓ | ✓ | x | | | | | | | | | | | |
| L4 + L22 | ✓ | ✓ | ✓ | x | | | | | | | | | | |
| L4 + L23 | ✓ | ✓ | ✓ | ✓ | x | | | | | | | | | |

TABLE 3-continued

| Modification of 3 loops |
|---|

| Pair | Pattern |
|---|---|
| L4 + L24 | ✓ ✓ ✓ ✓ ✓ x |
| L4 + L25 | ✓ ✓ ✓ ✓ ✓ ✓ x |
| L4 + L26 | ✓ ✓ ✓ ✓ ✓ ✓ ✓ x |
| L4 + L27 | ✓ ✓ ✓ ✓ ✓ ✓ ✓ ✓ x |
| L4 + L28 | ✓ ✓ ✓ ✓ ✓ ✓ ✓ ✓ ✓ x |
| L4 + L29 | ✓ ✓ ✓ ✓ ✓ ✓ ✓ ✓ ✓ ✓ x |
| L4 + L30 | ✓ ✓ ✓ ✓ ✓ ✓ ✓ ✓ ✓ ✓ ✓ x |
| L4 + L31 | ✓ ✓ ✓ ✓ ✓ ✓ ✓ ✓ ✓ ✓ ✓ ✓ x |
| L4 + L32 | ✓ ✓ ✓ ✓ ✓ ✓ ✓ ✓ ✓ ✓ ✓ ✓ ✓ x |
| L5 + L6 | |
| L5 + L7 | |
| L5 + L8 | |
| L5 + L9 | |
| L5 + L10 | |
| L5 + L11 | |
| L5 + L12 | |
| L5 + L13 | |
| L5 + L14 | |
| L5 + L15 | |
| L5 + L16 | |
| L5 + L17 | |
| L5 + L18 | |
| L5 + L19 | x |
| L5 + L20 | ✓ x |
| L5 + L21 | ✓ ✓ x |
| L5 + L22 | ✓ ✓ ✓ x |
| L5 + L23 | ✓ ✓ ✓ ✓ x |
| L5 + L24 | ✓ ✓ ✓ ✓ ✓ x |
| L5 + L25 | ✓ ✓ ✓ ✓ ✓ ✓ x |
| L5 + L26 | ✓ ✓ ✓ ✓ ✓ ✓ ✓ x |
| L5 + L27 | ✓ ✓ ✓ ✓ ✓ ✓ ✓ ✓ x |
| L5 + L28 | ✓ ✓ ✓ ✓ ✓ ✓ ✓ ✓ ✓ x |
| L5 + L29 | ✓ ✓ ✓ ✓ ✓ ✓ ✓ ✓ ✓ ✓ x |
| L5 + L30 | ✓ ✓ ✓ ✓ ✓ ✓ ✓ ✓ ✓ ✓ ✓ x |
| L5 + L31 | ✓ ✓ ✓ ✓ ✓ ✓ ✓ ✓ ✓ ✓ ✓ ✓ x |
| L5 + L32 | ✓ ✓ ✓ ✓ ✓ ✓ ✓ ✓ ✓ ✓ ✓ ✓ ✓ x |
| L6 + L7 | |
| L6 + L8 | |
| L6 + L9 | |
| L6 + L10 | |
| L6 + L11 | |
| L6 + L12 | |
| L6 + L13 | |
| L6 + L14 | |
| L6 + L15 | |
| L6 + L16 | |
| L6 + L17 | |
| L6 + L18 | |
| L6 + L19 | x |
| L6 + L20 | ✓ x |
| L6 + L21 | ✓ ✓ x |
| L6 + L22 | ✓ ✓ ✓ x |
| L6 + L23 | ✓ ✓ ✓ ✓ x |
| L6 + L24 | ✓ ✓ ✓ ✓ ✓ x |
| L6 + L25 | ✓ ✓ ✓ ✓ ✓ ✓ x |
| L6 + L26 | ✓ ✓ ✓ ✓ ✓ ✓ ✓ x |
| L6 + L27 | ✓ ✓ ✓ ✓ ✓ ✓ ✓ ✓ x |
| L6 + L28 | ✓ ✓ ✓ ✓ ✓ ✓ ✓ ✓ ✓ x |
| L6 + L29 | ✓ ✓ ✓ ✓ ✓ ✓ ✓ ✓ ✓ ✓ x |
| L6 + L30 | ✓ ✓ ✓ ✓ ✓ ✓ ✓ ✓ ✓ ✓ ✓ x |
| L6 + L31 | ✓ ✓ ✓ ✓ ✓ ✓ ✓ ✓ ✓ ✓ ✓ ✓ x |
| L6 + L32 | ✓ ✓ ✓ ✓ ✓ ✓ ✓ ✓ ✓ ✓ ✓ ✓ ✓ x |
| L7 + L8 | |
| L7 + L9 | |
| L7 + L10 | |
| L7 + L11 | |
| L7 + L12 | |
| L7 + L13 | |
| L7 + L14 | |
| L7 + L15 | |
| L7 + L16 | |
| L7 + L17 | |
| L7 + L18 | |
| L7 + L19 | x |
| L7 + L20 | ✓ x |
| L7 + L21 | ✓ ✓ x |
| L7 + L22 | ✓ ✓ ✓ x |
| L7 + L23 | ✓ ✓ ✓ ✓ x |

TABLE 3-continued

| | | | | | | | | | | | | | | |
|---|---|---|---|---|---|---|---|---|---|---|---|---|---|---|
| Modification of 3 loops | | | | | | | | | | | | | | |
| L7 + L24 | ✓ | ✓ | ✓ | ✓ | ✓ | x | | | | | | | | |
| L7 + L25 | ✓ | ✓ | ✓ | ✓ | ✓ | ✓ | x | | | | | | | |
| L7 + L26 | ✓ | ✓ | ✓ | ✓ | ✓ | ✓ | ✓ | x | | | | | | |
| L7 + L27 | ✓ | ✓ | ✓ | ✓ | ✓ | ✓ | ✓ | ✓ | x | | | | | |
| L7 + L28 | ✓ | ✓ | ✓ | ✓ | ✓ | ✓ | ✓ | ✓ | ✓ | x | | | | |
| L7 + L29 | ✓ | ✓ | ✓ | ✓ | ✓ | ✓ | ✓ | ✓ | ✓ | ✓ | x | | | |
| L7 + L30 | ✓ | ✓ | ✓ | ✓ | ✓ | ✓ | ✓ | ✓ | ✓ | ✓ | ✓ | x | | |
| L7 + L31 | ✓ | ✓ | ✓ | ✓ | ✓ | ✓ | ✓ | ✓ | ✓ | ✓ | ✓ | ✓ | x | |
| L7 + L32 | ✓ | ✓ | ✓ | ✓ | ✓ | ✓ | ✓ | ✓ | ✓ | ✓ | ✓ | ✓ | ✓ | x |
| L8 + L9 | | | | | | | | | | | | | | |
| L8 + L10 | | | | | | | | | | | | | | |
| L8 + L11 | | | | | | | | | | | | | | |
| L8 + L12 | | | | | | | | | | | | | | |
| L8 + L13 | | | | | | | | | | | | | | |
| L8 + L14 | | | | | | | | | | | | | | |
| L8 + L15 | | | | | | | | | | | | | | |
| L8 + L16 | | | | | | | | | | | | | | |
| L8 + L17 | | | | | | | | | | | | | | |
| L8 + L18 | | | | | | | | | | | | | | |
| L8 + L19 | x | | | | | | | | | | | | | |
| L8 + L20 | ✓ | x | | | | | | | | | | | | |
| L8 + L21 | ✓ | ✓ | x | | | | | | | | | | | |
| L8 + L22 | ✓ | ✓ | ✓ | x | | | | | | | | | | |
| L8 + L23 | ✓ | ✓ | ✓ | ✓ | x | | | | | | | | | |
| L8 + L24 | ✓ | ✓ | ✓ | ✓ | ✓ | x | | | | | | | | |
| L8 + L25 | ✓ | ✓ | ✓ | ✓ | ✓ | ✓ | x | | | | | | | |
| L8 + L26 | ✓ | ✓ | ✓ | ✓ | ✓ | ✓ | ✓ | x | | | | | | |
| L8 + L27 | ✓ | ✓ | ✓ | ✓ | ✓ | ✓ | ✓ | ✓ | x | | | | | |
| L8 + L28 | ✓ | ✓ | ✓ | ✓ | ✓ | ✓ | ✓ | ✓ | ✓ | x | | | | |
| L8 + L29 | ✓ | ✓ | ✓ | ✓ | ✓ | ✓ | ✓ | ✓ | ✓ | ✓ | x | | | |
| L8 + L30 | ✓ | ✓ | ✓ | ✓ | ✓ | ✓ | ✓ | ✓ | ✓ | ✓ | ✓ | x | | |
| L8 + L31 | ✓ | ✓ | ✓ | ✓ | ✓ | ✓ | ✓ | ✓ | ✓ | ✓ | ✓ | ✓ | x | |
| L8 + L32 | ✓ | ✓ | ✓ | ✓ | ✓ | ✓ | ✓ | ✓ | ✓ | ✓ | ✓ | ✓ | ✓ | x |
| L9 + L10 | | | | | | | | | | | | | | |
| L9 + L11 | | | | | | | | | | | | | | |
| L9 + L12 | | | | | | | | | | | | | | |
| L9 + L13 | | | | | | | | | | | | | | |
| L9 + L14 | | | | | | | | | | | | | | |
| L9 + L15 | | | | | | | | | | | | | | |
| L9 + L16 | | | | | | | | | | | | | | |
| L9 + L17 | | | | | | | | | | | | | | |
| L9 + L18 | | | | | | | | | | | | | | |
| L9 + L19 | x | | | | | | | | | | | | | |
| L9 + L20 | ✓ | x | | | | | | | | | | | | |
| L9 + L21 | ✓ | ✓ | x | | | | | | | | | | | |
| L9 + L22 | ✓ | ✓ | ✓ | x | | | | | | | | | | |
| L9 + L23 | ✓ | ✓ | ✓ | ✓ | x | | | | | | | | | |
| L9 + L24 | ✓ | ✓ | ✓ | ✓ | ✓ | x | | | | | | | | |
| L9 + L25 | ✓ | ✓ | ✓ | ✓ | ✓ | ✓ | x | | | | | | | |
| L9 + L26 | ✓ | ✓ | ✓ | ✓ | ✓ | ✓ | ✓ | x | | | | | | |
| L9 + L27 | ✓ | ✓ | ✓ | ✓ | ✓ | ✓ | ✓ | ✓ | x | | | | | |
| L9 + L28 | ✓ | ✓ | ✓ | ✓ | ✓ | ✓ | ✓ | ✓ | ✓ | x | | | | |
| L9 + L29 | ✓ | ✓ | ✓ | ✓ | ✓ | ✓ | ✓ | ✓ | ✓ | ✓ | x | | | |
| L9 + L30 | ✓ | ✓ | ✓ | ✓ | ✓ | ✓ | ✓ | ✓ | ✓ | ✓ | ✓ | x | | |
| L9 + L31 | ✓ | ✓ | ✓ | ✓ | ✓ | ✓ | ✓ | ✓ | ✓ | ✓ | ✓ | ✓ | x | |
| L9 + L32 | ✓ | ✓ | ✓ | ✓ | ✓ | ✓ | ✓ | ✓ | ✓ | ✓ | ✓ | ✓ | ✓ | x |
| L10 + L11 | | | | | | | | | | | | | | |
| L10 + L12 | | | | | | | | | | | | | | |
| L10 + L13 | | | | | | | | | | | | | | |
| L10 + L14 | | | | | | | | | | | | | | |
| L10 + L15 | | | | | | | | | | | | | | |
| L10 + L16 | | | | | | | | | | | | | | |
| L10 + L17 | | | | | | | | | | | | | | |
| L10 + L18 | | | | | | | | | | | | | | |
| L10 + L19 | x | | | | | | | | | | | | | |
| L10 + L20 | ✓ | x | | | | | | | | | | | | |
| L10 + L21 | ✓ | ✓ | x | | | | | | | | | | | |
| L10 + L22 | ✓ | ✓ | ✓ | x | | | | | | | | | | |
| L10 + L23 | ✓ | ✓ | ✓ | ✓ | x | | | | | | | | | |
| L10 + L24 | ✓ | ✓ | ✓ | ✓ | ✓ | x | | | | | | | | |
| L10 + L25 | ✓ | ✓ | ✓ | ✓ | ✓ | ✓ | x | | | | | | | |
| L10 + L26 | ✓ | ✓ | ✓ | ✓ | ✓ | ✓ | ✓ | x | | | | | | |
| L10 + L27 | ✓ | ✓ | ✓ | ✓ | ✓ | ✓ | ✓ | ✓ | x | | | | | |
| L10 + L28 | ✓ | ✓ | ✓ | ✓ | ✓ | ✓ | ✓ | ✓ | ✓ | x | | | | |
| L10 + L29 | ✓ | ✓ | ✓ | ✓ | ✓ | ✓ | ✓ | ✓ | ✓ | ✓ | x | | | |
| L10 + L30 | ✓ | ✓ | ✓ | ✓ | ✓ | ✓ | ✓ | ✓ | ✓ | ✓ | ✓ | x | | |
| L10 + L31 | ✓ | ✓ | ✓ | ✓ | ✓ | ✓ | ✓ | ✓ | ✓ | ✓ | ✓ | ✓ | x | |
| L10 + L32 | ✓ | ✓ | ✓ | ✓ | ✓ | ✓ | ✓ | ✓ | ✓ | ✓ | ✓ | ✓ | ✓ | x |

TABLE 3-continued

| Modification of 3 loops | | | | | | | | | | | | | | |
|---|---|---|---|---|---|---|---|---|---|---|---|---|---|---|
| L11 + L12 | | | | | | | | | | | | | | |
| L11 + L13 | | | | | | | | | | | | | | |
| L11 + L14 | | | | | | | | | | | | | | |
| L11 + L15 | | | | | | | | | | | | | | |
| L11 + L16 | | | | | | | | | | | | | | |
| L11 + L17 | | | | | | | | | | | | | | |
| L11 + L18 | | | | | | | | | | | | | | |
| L11 + L19 | x | | | | | | | | | | | | | |
| L11 + L20 | ✓ | x | | | | | | | | | | | | |
| L11 + L21 | ✓ | ✓ | x | | | | | | | | | | | |
| L11 + L22 | ✓ | ✓ | ✓ | x | | | | | | | | | | |
| L11 + L23 | ✓ | ✓ | ✓ | ✓ | x | | | | | | | | | |
| L11 + L24 | ✓ | ✓ | ✓ | ✓ | ✓ | x | | | | | | | | |
| L11 + L25 | ✓ | ✓ | ✓ | ✓ | ✓ | ✓ | x | | | | | | | |
| L11 + L26 | ✓ | ✓ | ✓ | ✓ | ✓ | ✓ | ✓ | x | | | | | | |
| L11 + L27 | ✓ | ✓ | ✓ | ✓ | ✓ | ✓ | ✓ | ✓ | x | | | | | |
| L11 + L28 | ✓ | ✓ | ✓ | ✓ | ✓ | ✓ | ✓ | ✓ | ✓ | x | | | | |
| L11 + L29 | ✓ | ✓ | ✓ | ✓ | ✓ | ✓ | ✓ | ✓ | ✓ | ✓ | x | | | |
| L11 + L30 | ✓ | ✓ | ✓ | ✓ | ✓ | ✓ | ✓ | ✓ | ✓ | ✓ | ✓ | x | | |
| L11 + L31 | ✓ | ✓ | ✓ | ✓ | ✓ | ✓ | ✓ | ✓ | ✓ | ✓ | ✓ | ✓ | x | |
| L11 + L32 | ✓ | ✓ | ✓ | ✓ | ✓ | ✓ | ✓ | ✓ | ✓ | ✓ | ✓ | ✓ | ✓ | x |
| L12 + L13 | | | | | | | | | | | | | | |
| L12 + L14 | | | | | | | | | | | | | | |
| L12 + L15 | | | | | | | | | | | | | | |
| L12 + L16 | | | | | | | | | | | | | | |
| L12 + L17 | | | | | | | | | | | | | | |
| L12 + L18 | | | | | | | | | | | | | | |
| L12 + L19 | x | | | | | | | | | | | | | |
| L12 + L20 | ✓ | x | | | | | | | | | | | | |
| L12 + L21 | ✓ | ✓ | x | | | | | | | | | | | |
| L12 + L22 | ✓ | ✓ | ✓ | x | | | | | | | | | | |
| L12 + L23 | ✓ | ✓ | ✓ | ✓ | x | | | | | | | | | |
| L12 + L24 | ✓ | ✓ | ✓ | ✓ | ✓ | x | | | | | | | | |
| L12 + L25 | ✓ | ✓ | ✓ | ✓ | ✓ | ✓ | x | | | | | | | |
| L12 + L26 | ✓ | ✓ | ✓ | ✓ | ✓ | ✓ | ✓ | x | | | | | | |
| L12 + L27 | ✓ | ✓ | ✓ | ✓ | ✓ | ✓ | ✓ | ✓ | x | | | | | |
| L12 + L28 | ✓ | ✓ | ✓ | ✓ | ✓ | ✓ | ✓ | ✓ | ✓ | x | | | | |
| L12 + L29 | ✓ | ✓ | ✓ | ✓ | ✓ | ✓ | ✓ | ✓ | ✓ | ✓ | x | | | |
| L12 + L30 | ✓ | ✓ | ✓ | ✓ | ✓ | ✓ | ✓ | ✓ | ✓ | ✓ | ✓ | x | | |
| L12 + L31 | ✓ | ✓ | ✓ | ✓ | ✓ | ✓ | ✓ | ✓ | ✓ | ✓ | ✓ | ✓ | x | |
| L12 + L32 | ✓ | ✓ | ✓ | ✓ | ✓ | ✓ | ✓ | ✓ | ✓ | ✓ | ✓ | ✓ | ✓ | x |
| L13 + L14 | | | | | | | | | | | | | | |
| L13 + L15 | | | | | | | | | | | | | | |
| L13 + L16 | | | | | | | | | | | | | | |
| L13 + L17 | | | | | | | | | | | | | | |
| L13 + L18 | | | | | | | | | | | | | | |
| L13 + L19 | x | | | | | | | | | | | | | |
| L13 + L20 | ✓ | x | | | | | | | | | | | | |
| L13 + L21 | ✓ | ✓ | x | | | | | | | | | | | |
| L13 + L22 | ✓ | ✓ | ✓ | x | | | | | | | | | | |
| L13 + L23 | ✓ | ✓ | ✓ | ✓ | x | | | | | | | | | |
| L13 + L24 | ✓ | ✓ | ✓ | ✓ | ✓ | x | | | | | | | | |
| L13 + L25 | ✓ | ✓ | ✓ | ✓ | ✓ | ✓ | x | | | | | | | |
| L13 + L26 | ✓ | ✓ | ✓ | ✓ | ✓ | ✓ | ✓ | x | | | | | | |
| L13 + L27 | ✓ | ✓ | ✓ | ✓ | ✓ | ✓ | ✓ | ✓ | x | | | | | |
| L13 + L28 | ✓ | ✓ | ✓ | ✓ | ✓ | ✓ | ✓ | ✓ | ✓ | x | | | | |
| L13 + L29 | ✓ | ✓ | ✓ | ✓ | ✓ | ✓ | ✓ | ✓ | ✓ | ✓ | x | | | |
| L13 + L30 | ✓ | ✓ | ✓ | ✓ | ✓ | ✓ | ✓ | ✓ | ✓ | ✓ | ✓ | x | | |
| L13 + L31 | ✓ | ✓ | ✓ | ✓ | ✓ | ✓ | ✓ | ✓ | ✓ | ✓ | ✓ | ✓ | x | |
| L13 + L32 | ✓ | ✓ | ✓ | ✓ | ✓ | ✓ | ✓ | ✓ | ✓ | ✓ | ✓ | ✓ | ✓ | x |
| L14 + L15 | | | | | | | | | | | | | | |
| L14 + L16 | | | | | | | | | | | | | | |
| L14 + L17 | | | | | | | | | | | | | | |
| L14 + L18 | | | | | | | | | | | | | | |
| L14 + L19 | x | | | | | | | | | | | | | |
| L14 + L20 | ✓ | x | | | | | | | | | | | | |
| L14 + L21 | ✓ | ✓ | x | | | | | | | | | | | |
| L14 + L22 | ✓ | ✓ | ✓ | x | | | | | | | | | | |
| L14 + L23 | ✓ | ✓ | ✓ | ✓ | x | | | | | | | | | |
| L14 + L24 | ✓ | ✓ | ✓ | ✓ | ✓ | x | | | | | | | | |
| L14 + L25 | ✓ | ✓ | ✓ | ✓ | ✓ | ✓ | x | | | | | | | |
| L14 + L26 | ✓ | ✓ | ✓ | ✓ | ✓ | ✓ | ✓ | x | | | | | | |
| L14 + L27 | ✓ | ✓ | ✓ | ✓ | ✓ | ✓ | ✓ | ✓ | x | | | | | |
| L14 + L28 | ✓ | ✓ | ✓ | ✓ | ✓ | ✓ | ✓ | ✓ | ✓ | x | | | | |
| L14 + L29 | ✓ | ✓ | ✓ | ✓ | ✓ | ✓ | ✓ | ✓ | ✓ | ✓ | x | | | |
| L14 + L30 | ✓ | ✓ | ✓ | ✓ | ✓ | ✓ | ✓ | ✓ | ✓ | ✓ | ✓ | x | | |
| L14 + L31 | ✓ | ✓ | ✓ | ✓ | ✓ | ✓ | ✓ | ✓ | ✓ | ✓ | ✓ | ✓ | x | |
| L14 + L32 | ✓ | ✓ | ✓ | ✓ | ✓ | ✓ | ✓ | ✓ | ✓ | ✓ | ✓ | ✓ | ✓ | x |

TABLE 3-continued

| Modification of 3 loops | | | | | | | | | | | | | | |
|---|---|---|---|---|---|---|---|---|---|---|---|---|---|---|
| L15 + L16 | | | | | | | | | | | | | | |
| L15 + L17 | | | | | | | | | | | | | | |
| L15 + L18 | | | | | | | | | | | | | | |
| L15 + L19 | x | | | | | | | | | | | | | |
| L15 + L20 | ✓ | x | | | | | | | | | | | | |
| L15 + L21 | ✓ | ✓ | x | | | | | | | | | | | |
| L15 + L22 | ✓ | ✓ | ✓ | x | | | | | | | | | | |
| L15 + L23 | ✓ | ✓ | ✓ | ✓ | x | | | | | | | | | |
| L15 + L24 | ✓ | ✓ | ✓ | ✓ | ✓ | x | | | | | | | | |
| L15 + L25 | ✓ | ✓ | ✓ | ✓ | ✓ | ✓ | x | | | | | | | |
| L15 + L26 | ✓ | ✓ | ✓ | ✓ | ✓ | ✓ | ✓ | x | | | | | | |
| L15 + L27 | ✓ | ✓ | ✓ | ✓ | ✓ | ✓ | ✓ | ✓ | x | | | | | |
| L15 + L28 | ✓ | ✓ | ✓ | ✓ | ✓ | ✓ | ✓ | ✓ | ✓ | x | | | | |
| L15 + L29 | ✓ | ✓ | ✓ | ✓ | ✓ | ✓ | ✓ | ✓ | ✓ | ✓ | x | | | |
| L15 + L30 | ✓ | ✓ | ✓ | ✓ | ✓ | ✓ | ✓ | ✓ | ✓ | ✓ | ✓ | x | | |
| L15 + L31 | ✓ | ✓ | ✓ | ✓ | ✓ | ✓ | ✓ | ✓ | ✓ | ✓ | ✓ | ✓ | x | |
| L15 + L32 | ✓ | ✓ | ✓ | ✓ | ✓ | ✓ | ✓ | ✓ | ✓ | ✓ | ✓ | ✓ | ✓ | x |
| L16 + L17 | | | | | | | | | | | | | | |
| L16 + L18 | | | | | | | | | | | | | | |
| L16 + L19 | x | | | | | | | | | | | | | |
| L16 + L20 | ✓ | x | | | | | | | | | | | | |
| L16 + L21 | ✓ | ✓ | x | | | | | | | | | | | |
| L16 + L22 | ✓ | ✓ | ✓ | x | | | | | | | | | | |
| L16 + L23 | ✓ | ✓ | ✓ | ✓ | x | | | | | | | | | |
| L16 + L24 | ✓ | ✓ | ✓ | ✓ | ✓ | x | | | | | | | | |
| L16 + L25 | ✓ | ✓ | ✓ | ✓ | ✓ | ✓ | x | | | | | | | |
| L16 + L26 | ✓ | ✓ | ✓ | ✓ | ✓ | ✓ | ✓ | x | | | | | | |
| L16 + L27 | ✓ | ✓ | ✓ | ✓ | ✓ | ✓ | ✓ | ✓ | x | | | | | |
| L16 + L28 | ✓ | ✓ | ✓ | ✓ | ✓ | ✓ | ✓ | ✓ | ✓ | x | | | | |
| L16 + L29 | ✓ | ✓ | ✓ | ✓ | ✓ | ✓ | ✓ | ✓ | ✓ | ✓ | x | | | |
| L16 + L30 | ✓ | ✓ | ✓ | ✓ | ✓ | ✓ | ✓ | ✓ | ✓ | ✓ | ✓ | x | | |
| L16 + L31 | ✓ | ✓ | ✓ | ✓ | ✓ | ✓ | ✓ | ✓ | ✓ | ✓ | ✓ | ✓ | x | |
| L16 + L32 | ✓ | ✓ | ✓ | ✓ | ✓ | ✓ | ✓ | ✓ | ✓ | ✓ | ✓ | ✓ | ✓ | x |
| L17 + L18 | | | | | | | | | | | | | | |
| L17 + L19 | x | | | | | | | | | | | | | |
| L17 + L20 | ✓ | x | | | | | | | | | | | | |
| L17 + L21 | ✓ | ✓ | x | | | | | | | | | | | |
| L17 + L22 | ✓ | ✓ | ✓ | x | | | | | | | | | | |
| L17 + L23 | ✓ | ✓ | ✓ | ✓ | x | | | | | | | | | |
| L17 + L24 | ✓ | ✓ | ✓ | ✓ | ✓ | x | | | | | | | | |
| L17 + L25 | ✓ | ✓ | ✓ | ✓ | ✓ | ✓ | x | | | | | | | |
| L17 + L26 | ✓ | ✓ | ✓ | ✓ | ✓ | ✓ | ✓ | x | | | | | | |
| L17 + L27 | ✓ | ✓ | ✓ | ✓ | ✓ | ✓ | ✓ | ✓ | x | | | | | |
| L17 + L28 | ✓ | ✓ | ✓ | ✓ | ✓ | ✓ | ✓ | ✓ | ✓ | x | | | | |
| L17 + L29 | ✓ | ✓ | ✓ | ✓ | ✓ | ✓ | ✓ | ✓ | ✓ | ✓ | x | | | |
| L17 + L30 | ✓ | ✓ | ✓ | ✓ | ✓ | ✓ | ✓ | ✓ | ✓ | ✓ | ✓ | x | | |
| L17 + L31 | ✓ | ✓ | ✓ | ✓ | ✓ | ✓ | ✓ | ✓ | ✓ | ✓ | ✓ | ✓ | x | |
| L17 + L32 | ✓ | ✓ | ✓ | ✓ | ✓ | ✓ | ✓ | ✓ | ✓ | ✓ | ✓ | ✓ | ✓ | x |
| L18 + L19 | x | | | | | | | | | | | | | |
| L18 + L20 | ✓ | x | | | | | | | | | | | | |
| L18 + L21 | ✓ | ✓ | x | | | | | | | | | | | |
| L18 + L22 | ✓ | ✓ | ✓ | x | | | | | | | | | | |
| L18 + L23 | ✓ | ✓ | ✓ | ✓ | x | | | | | | | | | |
| L18 + L24 | ✓ | ✓ | ✓ | ✓ | ✓ | x | | | | | | | | |
| L18 + L25 | ✓ | ✓ | ✓ | ✓ | ✓ | ✓ | x | | | | | | | |
| L18 + L26 | ✓ | ✓ | ✓ | ✓ | ✓ | ✓ | ✓ | x | | | | | | |
| L18 + L27 | ✓ | ✓ | ✓ | ✓ | ✓ | ✓ | ✓ | ✓ | x | | | | | |
| L18 + L28 | ✓ | ✓ | ✓ | ✓ | ✓ | ✓ | ✓ | ✓ | ✓ | x | | | | |
| L18 + L29 | ✓ | ✓ | ✓ | ✓ | ✓ | ✓ | ✓ | ✓ | ✓ | ✓ | x | | | |
| L18 + L30 | ✓ | ✓ | ✓ | ✓ | ✓ | ✓ | ✓ | ✓ | ✓ | ✓ | ✓ | x | | |
| L18 + L31 | ✓ | ✓ | ✓ | ✓ | ✓ | ✓ | ✓ | ✓ | ✓ | ✓ | ✓ | ✓ | x | |
| L18 + L32 | ✓ | ✓ | ✓ | ✓ | ✓ | ✓ | ✓ | ✓ | ✓ | ✓ | ✓ | ✓ | ✓ | x |
| L19 + L20 | x | x | | | | | | | | | | | | |
| L19 + L21 | x | ✓ | x | | | | | | | | | | | |
| L19 + L22 | x | ✓ | ✓ | x | | | | | | | | | | |
| L19 + L23 | x | ✓ | ✓ | ✓ | x | | | | | | | | | |
| L19 + L24 | x | ✓ | ✓ | ✓ | ✓ | x | | | | | | | | |
| L19 + L25 | x | ✓ | ✓ | ✓ | ✓ | ✓ | x | | | | | | | |
| L19 + L26 | x | ✓ | ✓ | ✓ | ✓ | ✓ | ✓ | x | | | | | | |
| L19 + L27 | x | ✓ | ✓ | ✓ | ✓ | ✓ | ✓ | ✓ | x | | | | | |
| L19 + L28 | x | ✓ | ✓ | ✓ | ✓ | ✓ | ✓ | ✓ | ✓ | x | | | | |
| L19 + L29 | x | ✓ | ✓ | ✓ | ✓ | ✓ | ✓ | ✓ | ✓ | ✓ | x | | | |
| L19 + L30 | x | ✓ | ✓ | ✓ | ✓ | ✓ | ✓ | ✓ | ✓ | ✓ | ✓ | x | | |
| L19 + L31 | x | ✓ | ✓ | ✓ | ✓ | ✓ | ✓ | ✓ | ✓ | ✓ | ✓ | ✓ | x | |
| L19 + L32 | x | ✓ | ✓ | ✓ | ✓ | ✓ | ✓ | ✓ | ✓ | ✓ | ✓ | ✓ | ✓ | x |
| L20 + L21 | | x | x | | | | | | | | | | | |
| L20 + L22 | | x | ✓ | x | | | | | | | | | | |
| L20 + L23 | | x | ✓ | ✓ | x | | | | | | | | | |

TABLE 3-continued

| Modification of 3 loops | | | | | | | | | | | | | |
|---|---|---|---|---|---|---|---|---|---|---|---|---|---|
| | L20 | L21 | L22 | L23 | L24 | L25 | L26 | L27 | L28 | L29 | L30 | L31 | L32 |
| L20 + L24 | x | ✓ | ✓ | ✓ | x | | | | | | | | |
| L20 + L25 | x | ✓ | ✓ | ✓ | ✓ | x | | | | | | | |
| L20 + L26 | x | ✓ | ✓ | ✓ | ✓ | ✓ | x | | | | | | |
| L20 + L27 | x | ✓ | ✓ | ✓ | ✓ | ✓ | ✓ | x | | | | | |
| L20 + L28 | x | ✓ | ✓ | ✓ | ✓ | ✓ | ✓ | ✓ | x | | | | |
| L20 + L29 | x | ✓ | ✓ | ✓ | ✓ | ✓ | ✓ | ✓ | ✓ | x | | | |
| L20 + L30 | x | ✓ | ✓ | ✓ | ✓ | ✓ | ✓ | ✓ | ✓ | ✓ | x | | |
| L20 + L31 | x | ✓ | ✓ | ✓ | ✓ | ✓ | ✓ | ✓ | ✓ | ✓ | ✓ | x | |
| L20 + L32 | x | ✓ | ✓ | ✓ | ✓ | ✓ | ✓ | ✓ | ✓ | ✓ | ✓ | ✓ | x |
| L21 + L22 | | x | x | | | | | | | | | | |
| L21 + L23 | | x | ✓ | x | | | | | | | | | |
| L21 + L24 | | x | ✓ | ✓ | x | | | | | | | | |
| L21 + L25 | | x | ✓ | ✓ | ✓ | x | | | | | | | |
| L21 + L26 | | x | ✓ | ✓ | ✓ | ✓ | x | | | | | | |
| L21 + L27 | | x | ✓ | ✓ | ✓ | ✓ | ✓ | x | | | | | |
| L21 + L28 | | x | ✓ | ✓ | ✓ | ✓ | ✓ | ✓ | x | | | | |
| L21 + L29 | | x | ✓ | ✓ | ✓ | ✓ | ✓ | ✓ | ✓ | x | | | |
| L21 + L30 | | x | ✓ | ✓ | ✓ | ✓ | ✓ | ✓ | ✓ | ✓ | x | | |
| L21 + L31 | | x | ✓ | ✓ | ✓ | ✓ | ✓ | ✓ | ✓ | ✓ | ✓ | x | |
| L21 + L32 | | x | ✓ | ✓ | ✓ | ✓ | ✓ | ✓ | ✓ | ✓ | ✓ | ✓ | x |
| L22 + L23 | | | x | x | | | | | | | | | |
| L22 + L24 | | | x | ✓ | x | | | | | | | | |
| L22 + L25 | | | x | ✓ | ✓ | x | | | | | | | |
| L22 + L26 | | | x | ✓ | ✓ | ✓ | x | | | | | | |
| L22 + L27 | | | x | ✓ | ✓ | ✓ | ✓ | x | | | | | |
| L22 + L28 | | | x | ✓ | ✓ | ✓ | ✓ | ✓ | x | | | | |
| L22 + L29 | | | x | ✓ | ✓ | ✓ | ✓ | ✓ | ✓ | x | | | |
| L22 + L30 | | | x | ✓ | ✓ | ✓ | ✓ | ✓ | ✓ | ✓ | x | | |
| L22 + L31 | | | x | ✓ | ✓ | ✓ | ✓ | ✓ | ✓ | ✓ | ✓ | x | |
| L22 + L32 | | | x | ✓ | ✓ | ✓ | ✓ | ✓ | ✓ | ✓ | ✓ | ✓ | x |
| L23 + L24 | | | | x | x | | | | | | | | |
| L23 + L25 | | | | x | ✓ | x | | | | | | | |
| L23 + L26 | | | | x | ✓ | ✓ | x | | | | | | |
| L23 + L27 | | | | x | ✓ | ✓ | ✓ | x | | | | | |
| L23 + L28 | | | | x | ✓ | ✓ | ✓ | ✓ | x | | | | |
| L23 + L29 | | | | x | ✓ | ✓ | ✓ | ✓ | ✓ | x | | | |
| L23 + L30 | | | | x | ✓ | ✓ | ✓ | ✓ | ✓ | ✓ | x | | |
| L23 + L31 | | | | x | ✓ | ✓ | ✓ | ✓ | ✓ | ✓ | ✓ | x | |
| L23 + L32 | | | | x | ✓ | ✓ | ✓ | ✓ | ✓ | ✓ | ✓ | ✓ | x |
| L24 + L25 | | | | | x | x | | | | | | | |
| L24 + L26 | | | | | x | ✓ | x | | | | | | |
| L24 + L27 | | | | | x | ✓ | ✓ | x | | | | | |
| L24 + L28 | | | | | x | ✓ | ✓ | ✓ | x | | | | |
| L24 + L29 | | | | | x | ✓ | ✓ | ✓ | ✓ | x | | | |
| L24 + L30 | | | | | x | ✓ | ✓ | ✓ | ✓ | ✓ | x | | |
| L24 + L31 | | | | | x | ✓ | ✓ | ✓ | ✓ | ✓ | ✓ | x | |
| L24 + L32 | | | | | x | ✓ | ✓ | ✓ | ✓ | ✓ | ✓ | ✓ | x |
| L25 + L26 | | | | | | x | x | | | | | | |
| L25 + L27 | | | | | | x | ✓ | x | | | | | |
| L25 + L28 | | | | | | x | ✓ | ✓ | x | | | | |
| L25 + L29 | | | | | | x | ✓ | ✓ | ✓ | x | | | |
| L25 + L30 | | | | | | x | ✓ | ✓ | ✓ | ✓ | x | | |
| L25 + L31 | | | | | | x | ✓ | ✓ | ✓ | ✓ | ✓ | x | |
| L25 + L32 | | | | | | x | ✓ | ✓ | ✓ | ✓ | ✓ | ✓ | x |
| L26 + L27 | | | | | | | x | x | | | | | |
| L26 + L28 | | | | | | | x | ✓ | x | | | | |
| L26 + L29 | | | | | | | x | ✓ | ✓ | x | | | |
| L26 + L30 | | | | | | | x | ✓ | ✓ | ✓ | x | | |
| L26 + L31 | | | | | | | x | ✓ | ✓ | ✓ | ✓ | x | |
| L26 + L32 | | | | | | | x | ✓ | ✓ | ✓ | ✓ | ✓ | x |
| L27 + L28 | | | | | | | | x | x | | | | |
| L27 + L29 | | | | | | | | x | ✓ | x | | | |
| L27 + L30 | | | | | | | | x | ✓ | ✓ | x | | |
| L27 + L31 | | | | | | | | x | ✓ | ✓ | ✓ | x | |
| L27 + L32 | | | | | | | | x | ✓ | ✓ | ✓ | ✓ | x |
| L28 + L29 | | | | | | | | | x | x | | | |
| L28 + L30 | | | | | | | | | x | ✓ | x | | |
| L28 + L31 | | | | | | | | | x | ✓ | ✓ | x | |
| L28 + L32 | | | | | | | | | x | ✓ | ✓ | ✓ | x |
| L29 + L30 | | | | | | | | | | x | x | | |
| L29 + L31 | | | | | | | | | | x | ✓ | x | |
| L29 + L32 | | | | | | | | | | x | ✓ | ✓ | x |
| L30 + L31 | | | | | | | | | | | x | x | |
| L30 + L32 | | | | | | | | | | | x | ✓ | x |
| L31 + L32 | | | | | | | | | | | | x | x |

REFERENCES

1. Schryvers A B. 04-26 1990. A Method for Isolating and Purifying Transferrin and Lactoferrin Receptor Proteins from Bacteria and the Preparation of Vaccines Containing the Same. France patent 0528787, 00528787/EP B1.
2. Quentin-Millet M-J, Lissolo L. Apr. 15, 1993 1993. Subunit vaccine for *Neisseria meningitidis* infections and corresponding purified subunits. PCT patent WO 93/07172.
3. Danve B, Lissolo L, Mignon M, Dumas P, Colombani S, Schryvers A B, Quentin-Millet M J. 1993. Transferrin-binding proteins isolated from *Neisseria meningitidis* elicit protective and bactericidal antibodies in laboratory animals. Vaccine 11:1214-1220.
4. Gray-Owen S D, Schryvers A B. 1996. Bacterial transferrin and lactoferrin receptors. Trends Microbiol 4:185-191.
5. Lo R Y C, Schryvers A B, Potter A A. 11-29 1996. Transferrin Binding Proteins of *Pasteurella Haemolytica* and Vaccines Containing Same patent 09720934 WO.
6. Loosmore S, Harkness R, Schryvers A, Chong P, Gray-Owen S, Yang Y-P, Murdin A, Klein M. 06-07 1995. Transferrin receptor genes and immunogenic compositions derived therefrom patent 05922323.
7. Schryvers A B. 06-07 1995. Vaccine for conferring bacterial immunity containing lactoferrin receptor protein patent 06060058.
8. Myers L E, Schryvers A B, Harkness R E, Loosmore S M, Du R-P, Yang Y-P, Klein M H. 03-08 1996. DNA encoding a transferrin receptor of *Moraxella* patent 06090576.
9. Potter A A, Gerlach G F, Willson P J, Rossi-Campos A. Mar. 2, 1999 1999. *Actinobacillus pleuropneumoniae* transferrin binding protein vaccines and uses thereof. U.S. Pat. No. 5,876,725.
10. Potter A A, Rioux C, Schryvers A B. 03-10 2000. Cloning and Expression of *Haemophilus Somnus* Transferrin-Binding Proteins patent 00053765 WO.
11. Morgenthau A, Pogoutse A, Adamiak P, Moraes T F, Schryvers A B. 2013. Bacterial receptors for host transferrin and lactoferrin: molecular mechanisms and role in host-microbe interactions. Future Microbiology 8:1575-1585.
12. Calmettes C, Yu R-H, Silva L P, Curran D, Schriemer D C, Schryvers A B, Moraes T F. 2011. Structural variations within the transferrin binding site on transferrin binding protein, TbpB. Journal of Biological Chemistry 286:12683-12692.
13. Moraes T F, Yu R-H, Strynadka N C, Schryvers A B. 2009. Insights into the bacterial transferrin receptor: the structure of transferrin binding protein B from *Actinobacillus pleuropneumoniae*. Molecular Cell 35:523-533.
14. Calmettes C, Alcantara J, Schryvers A B, Moraes T F. 2012. The structural basis of transferrin iron sequestration by transferrin binding protein B. Nature Structural and Molecular Biology 19:358-360.
15. Maiden M C, Ibarz-Pavon A B, Urwin R, Gray S J, Andrews N J, Clarke S C, Walker A M, Evans M R, Kroll J S, Neal K R, Ala'aldeen D A, Crook D W, Cann K, Harrison S, Cunningham R, Baxter D, Kaczmarski E, Maclennan J, Cameron J C, Stuart J M. 2008. Impact of meningococcal serogroup C conjugate vaccines on carriage and herd immunity. J Infect Dis 197:737-743.
16. Madhi S A, Adrian P, Kuwanda L, Cutland C, Albrich W C, Klugman K P. 2007. Long-term effect of pneumococcal conjugate vaccine on nasopharyngeal colonization by *Streptococcus pneumoniae*—and associated interactions with *Staphylococcus aureus* and *Haemophilus influenzae* colonization—in HIV-Infected and HIV-uninfected children. J Infect Dis 196:1662-1666.
17. Kellner J, Scheifele D, Vanderkooi O, MacDonald J, Church D. 2008. Effects of Routine Infant Vaccination with the 7-valent Pneumococcal Conjugate Vaccine on Nasopharyngeal Colonization with *Streptococcus pneumoniae* in Children in Calgary, Canada. Pediatr Infect Dis J 27:526-532.
18. Moxon R, Snape M D. 2013. The price of prevention: what now for immunisation against meningococcus B? Lancet 382:369-370.
19. Vipond C, Care R, Feavers I M. 2012. History of meningococcal vaccines and their serological correlates of protection. Vaccine 30 Suppl 2:B10-17.
20. Schryvers A B, Morris L J. 1988. Identification and characterization of the human lactoferrin-binding protein from *Neisseria meningitidis*. Infection and Immunity 56:1144-1149.
21. Schryvers A B, Morris L J. 1988. Identification and characterization of the transferrin receptor from *Neisseria meningitidis*. Molecular Microbiology 2:281-288.
22. Rokbi B, Renauld-Mongenie G, Mignon M, Danve B, Poncet D, Chabenel C, Caugant D A, Quentin-Millet M-J. 2000. Allelic diversity of the two transferrin binding protein B gene isotypes among a collection of *Neisseria meningitidis* strains representative of serogroup B disease: implication for the composition of a recombinant TbpB-based vaccine. Infection and Immunity 68:4938-4947.
23. Rich R L, Myszka D G. 2007. Higher-throughput, label-free, real-time molecular interaction analysis. Analytical biochemistry 361:1-6.
24. Abdiche Y, Malashock D, Pinkerton A, Pons J. 2008. Determining kinetics and affinities of protein interactions using a parallel real-time label-free biosensor, the Octet. Analytical biochemistry 377:209-217.
25. Velazquez-Campoy A, Leavitt S, Freire E. 2004. Characterization of protein-protein interactions by isothermal titration calorimetry. Methods Mol Biol 261:35-54.
26. Needleman S B, Wunsch C D. 1970. A general method applicable to the search for similarities in the amino acid sequence of two proteins. Journal of molecular biology 48:443-453.
27. Smith TFaMSW. 1981. Comparison of Biosequences. Advances in Applied Mathematics 2:482-489.
28. Thompson J D, Higgins D G, Gibson T J. 1994. CLUSTAL W: improving the sensitivity of progressive multiple sequence alignment through sequence weighting, position-specific gap penalties and weight matrix choice. Nucleic acids research 22:4673-4680.
29. Henikoff S, Henikoff J G. 1992. Amino acid substitution matrices from protein blocks. Proc Natl Acad Sci USA 89:10915-10919.
30. Carrillo H, and D. Lipman. 1989. The Multiple Sequence Alignment Problem in Biology. SIAM Journal on Applied Mathematics 48:1073-1082.
31. Devereux J, Haeberli P, Smithies O. 1984. A comprehensive set of sequence analysis programs for the VAX. Nucleic acids research 12:387-395.
32. Altschul S F, Gish W, Miller W, Myers E W, Lipman D J. 1990. Basic local alignment search tool. Journal of Molecular Biology 215:403-410.
33. Green M R, Sambrook J. 2012. Molecular Cloning: A Laboratory Manual. Cold Spring Harbor Laboratory Press, Cold Spring Harbor, N.Y.

34. Gonzalez G C, Caamano D L, Schryvers A B. 1990. Identification and characterization of a porcine-specific transferrin receptor in *Actinobacillus pleuropneumoniae*. Molecular Microbiology 4:1173-1179.
35. Gray-Owen S D, Loosmore S, Schryvers A B. 1995. Identification and characterization of genes encoding the human transferrin binding proteins from *Haemophilus influenzae*. Infection and Immunity 63:1201-1210.
36. Gray-Owen S D, Schryvers A B. 1995. Characterization of transferrin binding proteins 1 and 2 in invasive type b and nontypable strains of *Haemophilus influenzae*. Infection and Immunity 63:3809-3815.
37. Frandoloso R, Martínez S, Rodríguez-Ferri E F, García-Iglesias M J, Pérez-Martínez C, Martinez-Fernandez B, Gutierrez-Martin C B. 2011. Development and characterization of protective *Haemophilus parasuis* subunit vaccines based on native proteins with affinity to porcine transferrin and comparison with other subunit and commercial vaccines. Clinical and Vaccine Immunology 18:50-58.
38. Ogunnariwo J A, Schryvers A B. 1990. Iron acquisition in *Pasteurella haemolytica*: Expression and identification of a bovine-specific transferrin receptor. Infection and Immunity 58:2091-2097.
39. Ogunnariwo J A, Cheng C Y, Ford J A, Schryvers A B. 1990. Response of *Haemophilus somnus* to iron limitation: Expression and identification of a bovine-specific transferrin receptor. Microbial Pathogenesis 9:397-406.
40. Myers L E, Yang Y-P, Du R-P, Wang Q, Harkness R E, Schryvers A B, Klein M H, Loosmore S M. 1998. The transferrin binding protein B of *Moraxella catarrhalis* elicits bactericidal antibodies and is a potential vaccine antigen. Infection and Immunity 66:4183-4192.
41. Adamiak P, Calmettes C, Moraes T F, Schryvers A B. 2014. Patterns of structural and sequence variation within isotype lineages of the *Neisseria meningitidis* transferrin receptor system. Microbiology Open Submitted.
42. Harrison O B, Maiden M C, Rokbi B. 2008. Distribution of transferrin binding protein B gene (tbpB) variants among *Neisseria* species. BMC Microbiol 8:66.
43. Moretti S, Armougom F, Wallace I M, Higgins D G, Jongeneel C V, Notredame C. 2007. The M-Coffee web server: a meta-method for computing multiple sequence alignments by combining alternative alignment methods. Nucleic acids research 35:W645-648.
44. Drummond A J, Ashton B, Buxton S, Cheung M, Cooper A, Duran C, Field M, Heled J, Kearse M, Markowitz S, Moir R, Stones-Havas S, Sturrock S, Thierer T, Wilson A. 2011. Geneious, 5.4 ed.
45. Castresana J. 2000. Selection of Conserved Blocks from Multiple Alignments for Their Use in Phylogenetic Analysis. Mol Biol Evol 17:540-552.
46. Guindon S, Dufayard J-F, Lefort V, Anisimova M, Hordijk W, Gascuel O. 2010. New Algorithms and Methods to Estimate Maximum-Likelihood Phylogenies: Assessing the Performance of PhyML 3.0. Systematic Biology 59:307-321.
47. Tavare S. 1986. Some Probabilistic and Statistical Problems in the Analysis of DNA Sequences. Lectures on Mathematics in the Life Sciences 17:57-86.
48. Dereeper A, Guignon V, Blanc G, Audic S, Buffet S, Chevenet F, Dufayard J-F, Guindon S, Lefort V, Lescot M, Claverie J-M, Gascuel O. 2008. Phylogeny.fr: robust phylogenetic analysis for the non-specialist. Nucleic Acids Research 36:W465-W469.
49. Dereeper A, Audic S, Claverie J-M, Blanc G. 2010. BLAST-EXPLORER helps you building datasets for phylogenetic analysis. BMC Evol Biol 10:8.
50. DeWinter L M, Schryvers A B. 2002. Methods for Manipulation of Transferrin-Binding Proteins, p. 109-120. In Pollard A J, Maiden M C (ed.), Meningococcal Vaccines: Methods and Protocols, vol. 66. Humana Press Inc., Totowa, N.J.
51. Schryvers A B, Lee B C. 1993. Analysis of bacterial receptors for host iron binding proteins. J. Microbiol. Methods 18:255-266.
52. Niedz R P, Sussman M R, Satterlee J S. 1995. Green Fluorescent Protein—an in-Vivo Reporter of Plant Gene-Expression. Plant Cell Rep 14:403-406.
53. Janson J-C. 2013. Protein Purification: Principles, High Resolution Methods, and Application, vol. 54. Wiley.
54. Wilson-Welder J H, Torres M P, Kipper M J, Mallapragada S K, Wannemuehler M J, Narasimhan B. 2009. Vaccine Adjuvants: Current Challenges and Future Approaches. J Pharm Sci-Us 98:1278-1316.
55. Li Z, Kessler W, van den Heuvel J, Rinas U. 2011. Simple defined autoinduction medium for high-level recombinant protein production using T7-based *Escherichia coli* expression systems. Appl Microbiol Biotechnol 91:1203-1213.
56. Jolley K, Maiden M. 2010. BIGSdb: Scalable analysis of bacterial genome variation at the population level. BMC Bioinformatics 11:595.
57. Horton R M, Cai Z, Ho S N, Pease L R. 1990. Gene splicing by overlap extension: Tailor-made genes using the polymerase chain reaction. Biotechniques 8:528-535.
58. Noinaj N, Easley N C, Oke M, Mizuno N, Gumbart J, Boura E, Steere A N, Zak O, Aisen P, Tajkhorshid E, Evans R W, Gorringe A R, Mason A B, Steven A C, Buchanan S K. 2012. Structural basis for iron piracy by pathogenic *Neisseria*. Nature 483:53-58.
59. Morgenthau A, Adamiak P, Livingstone M J, Schryvers A B. 2012. The role of lactoferrin binding protein B in mediating protection against lactoferricin. Biochem Cell Biol 90:417-423.
60. de la Fuente A J, Gutiérrez-Martín C B, Rodríguez-Barbosa J I, Martínez-Martínez S, Frandoloso R, Tejerina F, Rodriguez-Ferri E F. 2009. Blood cellular immune response in pigs immunized and challenged with *Haemophilus parasuis*. Res Vet Sci 86:230-234.
61. Gray-Owen S D. 2003. Neisserial Opa proteins: impact on colonization, dissemination and immunity. Scand J Infect Dis 35:614-618.
62. Johswich K O, McCaw S E, Islam E, Sintsova A, Gu A, Shively J E, Gray-Owen S D. 2013. In Vivo Adaptation and Persistence of *Neisseria meningitidis* within the Nasopharyngeal Mucosa. PLoS Pathog 9:e1003509.
63. Mell J C, Redfield R J. 2014. Natural competence and the evolution of DNA uptake specificity. J Bacteriol 196:1471-1483.
64. Redfield R J, Findlay W A, Bosse J, Kroll J S, Cameron A D, Nash J H. 2006. Evolution of competence and DNA uptake specificity in the Pasteurellaceae. BMC Evol Biol 6:82.
65. Ulanova M, Tsang R, Altman E. 2012. Neglected infectious diseases in Aboriginal communities: *Haemophilus influenzae* serotype a and *Helicobacter pylori*. Vaccine 30:6960-6966.
66. Lee I, Davies R L. 2011. Evidence for a common gene pool and frequent recombinational exchange of the tbpBA operon in *Mannheimia haemolytica, Mannheimia glucosida* and *Bibersteinia trehalosi*. Microbiology 157:123-135.

SEQUENCE LISTING (317 sequences)

SEQ ID NO: 1 - DNA, 1640 bp, Actinobacillus pleuropneumoniae
atgcattttaaacttaatccctatgcgttagcgtttacttcgctgtttcttgtcgcttgttctggcggaaaaggaagttttgatttagaagatgtccggcctaataagacaacaggcgtgtctaaagaggagtacaaggatgtagaaacagccaagaaagaaaaagaacagttaggggaattaatggaacctgctttggggtatgttgtaaaagttccggtgagttcttttgaaaataagaaagttgatatttcagatatagaagtgattacgaacggaaatttagacgatgtgccgtacaaggcaaattcatctaaatataactatccagatataaaaacaaaagattcttctcttcagtacgttcgctcaggatatgttattgatggggaacactctggttctaatgaaaagggatatgtgtattataaaggtaattcacctgcaaaagaattacccgttaatcagcttttaacttatacaggaagttgggattttacttccaatgcaaatttaaataatgaagagggaagacctaattatttaaacgacgattattatactaaatttataggtaaacgggtgggcttggtttcgggagatgcgaaacctgcaaagcataaatacactagccagtttgaagttgattttgcaactaaaaaaatgacaggtaaattatccgataaagagaaaacgatttatacagtcaatgctgatattagaggcaatcgttttacgggggctgctacagcgagtgataaaaataaagggaaaggcgaatcatataacttctttagtgccgattctcagtctttagaaggcggcttctatggtccaaaagcagaagaaatggcagggaaatttgtagctaacgacaaatctctttttgccgttttttcagcaaaacacaatggctctaatgttgacaccgttcgtattattgatgcctcaaaaattgatttaactaatttcagcatttcagaacttaacaattttggtgatgcttccgttttaattattgatgggaaaaaaataaagctagctggtagcgggtttacaaataagcacactattgaaatcaatggcaaaacaatggtagccgtagcctgctgtagtaatctggaatatatgaagtttggtcaattatggcaacaagcagagggcggaaaacccgagaataatagtttattcctacaaggcgaacgtaccgcaacagataagatgccaaaaggcggaaactataaatatattggtacttgggatgctcaggtttcaaaagaaaataactgggttgctacggcagatgatgatagaaaagctggctatcgcacagaatttgatgttgattttggcaacaaaaatttaagtggtaagttatttgataaaaacggtgtaaatcctgtgtttaccgtagatgcaaaaattgatggtaatggttttactggcaaagctaaaacctcagatgctggtttcgctctagattcaggtagttcacgttatgagaatgtgaaatttaacgatgtagcagttagtggtggcttctatggtccaacggcagcagagcttggcggacaattccaccataaatcagaaaatggcagtgtaggtgctgtctttggtgcaaaacaacaagtaaaaaa

SEQ ID NO: 2 - protein, 540 aa, Actinobacillus pleuropneumoniae
MHFKLNPYALAFTSLFLVACSGGKGSFDLEDVRPNKTTGVSKEEYKDVETAKKEKEQLGELMEPALGYVVKVPVSSFENKKVDISDIEVITNGNLDDVPYKANSSKYNYPDIKTKDSSLQYVRSGYVIDGEHSGSNEKGYVYYKGNSPAKELPVNQLLTYTGSWDFTSNANLNNEEGRPNYLNDDYYTKFIGKRVGLVSGDAKPAKHKYTSQFEVDFATKKMTGKLSDKEKTIYTVNADIRGNRFTGAATASDKNKGKGESYNFFSADSQSLEGGFYGPKAEEMAGKFVANDKSLFAVFSAKHNGSNVDTVRIIDASKIDLTNFSISELNNFGDASVLIIDGKKIKLAGSGFTNKHTIEINGKTMVAVACCSNLEYMKFGQLWQQAEGGKPENNSLFLQGERTATDKMPKGGNYKYIGTWDAQVSKENNWVATADDDRKAGYRTEFDVDFGNKNLSGKLFDKNGVNPVFTVDAKIDGNGFTGKAKTSDAGFALDSGSSRYENVKFNDVAVSGGFYGPTAAELGGQFHHKSENGSVGAVFG

SEQ ID NO: 3 - DNA, 1640 bp, Actinobacillus pleuropneumoniae
atgcattttaaacttaatccctatgcgttagcgtttacttcgctgtttcttgtcgcttgttctggcggaaaaggaagttttgatttagaagatgtccggcctaataagacaacaggcgtgtctaaagaggagtacaaggatgtagaaacagccaagaaagaaaaagaacagttaggggaattaatggaacctgctttggggtatgttgtaaaagttccggtgagttcttttgaaaataagaaagttgatatttcagatatagaagtgattacgaacggaaatttagacgatgtgccgtacaaggcaaattcatctaaatataactatccagatataaaaacaaaagattcttctcttcagtacgttcgctcaggatatgttattgatggggaacactctggttctaatgaaaagggatatgtgtattataaaggtaattcacctgcaaaagaattacccgttaatcagcttttaacttatacaggaagttgggattttacttccaatgcaaatttaaataatgaagagggaagacctaattatttaaacgacgattattatactaaagcaataggtaaacgggtgggcttggtttcgggagatgcgaaacctgcaaagcataaatacactagccagtttgaagttgattttgcaactaaaaaaatgacaggtaaattatccgataaagagaaaacgatttatacagtcaatgctgatattagaggcaatcgttttacgggggctgctacagcgagtgataaaaataaagggaaaggcgaatcatataacttctttagtgccgattctcagtctttagaaggcggcttctatggtccaaaagcagaagaaatggcagggaaatttgtagctaacgacaaatctctttttgccgttttttcagcaaaacacaatggctctaatgttgacaccgttcgtattattgatgcctcaaaaattgatttaactaatttcagcatttcagaacttaacaattttggtgatgcttccgttttaattattgatgggaaaaaaataaagctagctggtagcgggtttacaaataagcacactattgaaatcaatggcaaaacaatggtagccgtagcctgctgtagtaatctggaatatatgaagtttggtcaattatggcaacaagcagagggcggaaaacccgagaataatagtttattcctacaaggcgaacgtaccgcaacagataagatgccaaaaggcggaaactataaatatattggtacttgggatgctcaggtttcaaaagaaaataactgggttgctacggcagatgatgatagaaaagctggctatcgcacagaatttgatgttgattttggcaacaaaaatttaagtggtaagttatttgataaaaacggtgtaaatcctgtgtttaccgtagatgcaaaaattgatggtaatggttttactggcaaagctaaaacctcagatgctggtttcgctctagattcaggtagttcacgttatgagaatgtgaaatttaacgatgtagcagttagtggtggcttctatggtccaacggcagcagagcttggcggacaattccaccataaatcagaaaatggcagtgtaggtgctgtctttggtgcaaaacaacaagtaaaaaa

SEQ ID NO: 4 - protein, 540 aa, Actinobacillus pleuropneumoniae
MHFKLNPYALAFTSLFLVACSGGKGSFDLEDVRPNKTTGVSKEEYKDVETAKKEKEQLGELMEPALGYVVKVPVSSFENKKVDISDIEVITNGNLDDVPYKANSSKYNYPDIKTKDSSLQYVRSGYVIDGEHSGSNEKGYVYYKGNSPAKELPVNQLLTYTGSWDFTSNANLNNEEGRPNYLNDDYYTKAIGKRVGLVSGDAKPAKHKYTSQFEVDFATKKMTGKLSDKEKTIYTVNADIRGNRFTGAATASDKNKGKGESYNFFSADSQSLEGGFYGPKAEEMAGKFVANDKSLFAVFSAKHNGSNVDTVRIIDASKIDLTNFSISELNNFGDASVLIIDGKKIKLAGSGFTNKHTIEINGKTMVAVACCSNLEYMKFGQLWQQAEGGKPENNSLFLQGERTATDKMPKGGNYKYIGTWDAQVSKENNWVATADDDRKAGYRTEFDVDFGNKNLSGKLFDKNGVNPVFTVDAKIDGNGFTGKAKTSDAGFALDSGSSRYENVKFNDVAVSGGFYGPTAAELGGQFHHKSENGSVGAVFG

SEQ ID NO: 5 - DNA, 730 bp, Actinobacillus pleuropneumoniae
caatggctctaatgttgacaccgttcgtattattgatgcctcaaaaattgatttaactaatttcagcatttcagaacttaacaattttggtgatgcttccgttttaattattgatgggaaaaaaataaagctagctggtagcgggtttacaaataagcacactattgaaatcaatggcaaaacaatggtagccgtagcctgctgtagtaatctggaatatatgaagtttggtcaattatggcaacaagcagagggcggaaaacccgagaataatagtttattcctacaaggcgaacgtaccgcaacagataagatgccaaaaggcggaaactataaatatattggtacttgggatgctcaggtttcaaaagaaaataactgggttgctacggcagatgatgatagaaaagctggctatcgcacagaatttgatgttgattttggcaacaaaaatttaagtggtaagttatttgataaaaacggtgtaaatcctgtgtttaccgtagatgcaaaaattgatggtaatggttttactggcaaagctaaaacctcagatgctggtttcgctctagattcaggtagttcacgttatgagaatgtgaaatttaacgatgtagcagttagtggtggcttctatggtccaacggcagcagagcttggcggacaattccaccataaatcagaaaatggcagtgtaggtgctgtctttggtgcaaaacaacaagtaaaa

SEQ ID NO: 6 - protein, 240 aa, Actinobacillus pleuropneumoniae
HNGSNVDTVRIIDASKIDLTNFSISELNNFGDASVLIIDGKKIKLAGSGFTNKHTIEINGKTMVAVACCSNLEYMKFGQLWQQAEGGKPENNSLFLQGERTATDKMPKGGNYKYIGTWDAQVSKENNWVATADDDRKAGYRTEFDVDFGNKNLSGKLFDKNGVNPVFTVDAKIDGNGFTGKAKTSDAGFALDSGSSRYENVKFNDVAVSGGFYGPTAAELGGQFHHKSENGSVGAVFGAK

SEQ ID NO: 7 - DNA, 900 bp, Actinobacillus pleuropneumoniae
atgcattttaaacttaatccctatgcgttagcgtttacttcgctgtttcttgtcgcttgttctggcggaaaaggaagttttgatttagaagatgtccggcctaataagacaacaggcgtgtctaaagaggagtacaaggatgtagaaacagccaagaaagaaaaagaacagttaggggaattaatggaacctgctttggggtatgttgtaaaagttccggtgagttcttttgaaaataagaaagttgatatttcagatatagaagtgattacgaacggaaatttagacgatgtgccgtacaaggcaaattcatctaaatataactatccagatataaaaacaaaagattcttctcttcagtacgttcgctcaggatatgttattgatggggaacactctggttctaatgaaaagggatatgtgtattataaaggtaattcacctgcaaaagaattacccgttaatcagcttttaacttatacaggaagttgggattttacttccaatgcaaatttaaataatgaagagggaagacctaattatttaaacgacgattattatactaaatttataggtaaacgggtgggcttggtttcgggagatgcgaaacctgcaaagcataaatacactagccagtttgaagttgattttgcaactaaaaaaatgacaggtaaattatccgataaagagaaaacgatttatacagtcaatgctgatattagaggcaatcgttttacgggggctgctacagcgagtgataaaaataaagggaaaggcgaatcatataacttctttagtgccgattctcagtctttagaaggcggcttctatggtccaaaagcagaagaaatggcagggaaatttgtagctaacgacaaatctctttttgccgttttttca

SEQ ID NO: 8 - protein, 280 aa, Actinobacillus pleuropneumoniae
CSGGKGSFDLEDVRPNKTTGVSKEEYKDVETAKKEKEQLGELMEPALGYVVKVPVSSFENKKVDISDIEVITNGNLDDVPYKANSSKYNYPDIKTKDSSLQYVRSGYVIDGEHSGSNEKGYVYYKGNSPAKELPVNQLLTYTGSWDFTSNANLNNEEGRPNYLNDDYYTKFIGKRVGLVSGDAKPAKHKYTSQFEVDFATKKMTGKLSDKEKTIYTVNADIRGNRFTGAATASDKNKGKGESYNFFSADSQSLEGGFYGPKAEEMAGKFVANDKSLFAVF

SEQ ID NO: 9 - DNA, 744 bp, Actinobacillus pleuropneumoniae
ggatccggcgtgtcaaaagaagaatacaaagatgtggaaaccgctaaaaaagaaaaagaacaactgggcgaactgggtgaactgatggaaccggcactgggctatgtggttaaagtcccggtgtcagctggtaaaaaagtcgatatttcggacatcgaagtgattaccaacggcaatctggatgacgtgccgtacaaagccaatagctctaaatataactacccggatatcaaaacgaaagacagttccctgcagtatgtgcgtagcggctacgttatttctccggatggcggttatgtttattacaagggtaattctccggcaaaagaactgccggtcaaccaactgctgacctacacgggcagttgggattttaccagcaacgctaatctgaacgcagcacgtccggcaggtgcaggtaaacgcgttggcctggtcagcggtgatgcgaaagaacgcaaatataccagccagtttgaagtggacttcgccaccaagaaaatgacgggtaaactgagcgataaagaaaaaaccatctacacggttaatgcggacattcgtggcaaccgctttaccggtgcagctacggcgagcgataaaaatgacccgatcctgtctgccgattcacaatcgctggaaggcggtttctatggcccgaaagcagaagaaatggctggtaaattcgtggcaaatgacaaatcgctgttcgcagtcttctccgctaaacacaatggctccaatgtc

SEQ ID NO: 10 - protein, 248 aa, Actinobacillus pleuropneumoniae
GSGVSKEEYKDVETAKKEKEQLGELGELMEPALGYVVKVPVSAGKKVDISDIEVITNGNLDDVPYKANSSKYNYPDIKTKDSSLQYVRSGYVISPDGGYVYYKGNSPAKELPVNQLLTYTGSWDFTSNANLNAARPAGAGKRVGLVSGDAKERKYTSQFEVDFATKKMTGKLSDKEKTIYTVNADIRGNRFTGAATASDKNDPILSADSQSLEGGFYGPKAEEMAGKFVANDKSLFAVFSAKHNGSNV

SEQ ID NO: 11 - DNA, 1640 bp, Actinobacillus pleuropneumoniae
atgcattttaaatccgacctatatatagtagctcttacctcaactttccttgtagcttgttctggtggaaaaggtagctttgatttggatgatgttcaaccaaataaagccgttgaaccagaaaaaacaaaagtgaattataccgacgaagaaacacaaaaaaggaaaaaagaagagttagataagttgatggaacctgctttgggatatgtaacaaaaatcccagtcaatatacctagtgtaagaaaaacagaaatttcagaaattgatacagtgactgatgaatctctctctctcgttccaaatgaggacaaattaagaacaatcgctaacgagaattatgggtcggtagtaacaaaatctggaagtaacactatgaattttgttcgttctggatatacgattgatgttgttcattatggtttaagagataaaggatatgtttactacaaaggagttcatccttccaaagagctccctaaaggcaatattatcgtttatcaaggagagtgggactttacctcaaatgccgatctagatgccaaaagaccaaattacaatcctgaatttaatggctatggcgcagggcaaagagttggagttacttctgcagatgcaaaagaaagaacttatatctcgaagttcaacatagatttttcaaataagaaattgaatggtcagttacttactaaaacaaaagaaaatcaagaaaaattacgctataccgttgaagctaacattagtggcaatcgttttagaggaaaagcgactgctactgataaaacagatccgatattaggtaaagattctgagcatcttgaaggtggcttatatggtccaaaatcagaagaacttgcaggaaaatttgtagctcatgataaatctctttttgcggtattctctggcaaaagaggtaatgacgttcttgaaacagtcaagatcattgatgcctcaaaaattgatttaactacttttgaatcatcggaactcaacaatttcggcaacgctaatgtgttaattattgatggacagaaaatagatctagcaggtgcagattttaaaaatagaaaaaccgttgatatcaatggtaagacaatggtagccatagcttgctgtagtaatttggaatatatgaaatttggtcaattatggcaaaaagagggcgaacaaactaaagataatagcttattcctgcaaggtgagcgtactgccacagataaaatacccgtaggtggaaactataaatatgtaggaacctgggatgcactcgtttcaaaaggaacgaactgggtagctgaggcggataataatcgagaatcgggctatcgctcagaatttgatgttaattttggtgataaaaaagtaagcggcaagttatttgataaagggggcatagtacctgtctttatgatcaacgcagatattaaaggtaacggctttactgggacagctaacactacagatacaggctttgcgttagattcaggctctagccaacacggaaatgcggtatttagtgatataaaagtcaatggtggcttctatggtccaaccgctggagaacttggcggacaattccatcataaatcagacaatggcagtgttggcgctgtctttggtgcaaaacgacaaatagaaaa

SEQ ID NO: 12 - protein, 540 aa, Actinobacillus pleuropneumoniae
MHFKSDLYIVALTSTFLVACSGGKGSFDLDDVQPNKAVEPEKTKVNYTDEETQKRKKEELDKLMEPALGYVTKIPVNIPSVRKTEISEIDTVTDESLSLVPNEDKLRTIANENYGSVVTKSGSNTMNFVRSGYTIDVVHYGLRDKGYVYYKGVHPSKELPKGNIIVYQGEWDFTSNADLDAKRPNYNPEFNGYGAGQRVGVTSADAKERTYISKFNIDFSNKKLNGQLLTKTKENQEKLRYTVEANISGNRFRGKATATDKTDPILGKDSEHLEGGLYGPKSEELAGKFVAHDKSLFAVFSGKRGNDVLETVKIIDASKIDLTTFESSELNNFGNANVLIIDGQKIDLAGADFKNRKTVDINGKTMVAIACCSNLEYMKFGQLWQKEGEQTKDNSLFLQGERTATDKIPVGGNYKYVGTWDALVSKGTNWVAEADNNRESGYRSEFDVNFGDKKVSGKLFDKGGIVPVFMINADIKGNGFTGTANTTDTGFALDSGSSQHGNAVFSDIKVNGGFYGPTAGELGGQFHHKSDNGSVGAVFG

SEQ ID NO: 13 - DNA, 1640 bp, Actinobacillus pleuropneumoniae
atgcattttaaatccgacctatatatagtagctcttacctcaactttccttgtagcttgttctggtggaaaaggtagctttgatttggatgatgttcaaccaaataaagccgttgaaccagaaaaaacaaaagtgaattataccgacgaagaaacacaaaaaaggaaaaaagaagagttagataagttgatggaacctgctttgggatatgtaacaaaaatcccagtcaatatacctagtgtaagaaaaacagaaatttcagaaattgatacagtgactgatgaatctctctctctcgttccaaatgaggacaaattaagaacaatcgctaacgagaatgctgggtcggtagtaacaaaatctggaagtaacactatgaattttgttcgttctggatatacgattgatgttgttcattatggtttaagagataaaggatatgtttactacaaaggagttcatccttccaaagagctccctaaaggcaatattatcgtttatcaaggagagtgggactttacctcaaatgccgatctagatgccaaaagaccaaattacaatcctgaatttaatggctatggcgcagggcaaagagttggagttacttctgcagatgcaaaagaaagaacttatatctcgaagttcaacatagatttttcaaataagaaattgaatggtcagttacttactaaaacaaaagaaaatcaagaaaaattacgctataccgttgaagctaacattagtggcaatcgttttagaggaaaagcgactgctactgataaaacagatccgatattaggtaaagattctgagcatcttgaaggtggcttatatggtccaaaatcagaagaacttgcaggaaaatttgtagctcatgataaatctctttttgcggtattctctggcaaaagaggtaatgacgttcttgaaacagtcaagatcattgatgcctcaaaaattgatttaactacttttgaatcatcggaactcaacaatttcggcaacgctaatgtgttaattattgatggacagaaaatagatctagcaggtgcagattttaaaaatagaaaaaccgttgatatcaatggtaagacaatggtagccatagcttgctgtagtaatttggaatatatgaaatttggtcaattatggcaaaaagagggcgaacaaactaaagataatagcttattcctgcaaggtgagcgtactgccacagataaaatacccgtaggtggaaactataaatatgtaggaacctgggatgcactcgtttcaaaaggaacgaactgggtagctgaggcggataataatcgagaatcgggctatcgctcagaatttgatgttaattttggtgataaaaaagtaagcggcaagttatttgataaagggggcatagtacctgtctttatgatcaacgcagatattaaaggtaacggctttactgggacagctaacactacagatacaggctttgcgttagattcaggctctagccaacacggaaatgcggtatttagtgatataaaagtcaatggtggcttctatggtccaaccgctggagaacttggcggacaattccatcataaatcagacaatggcagtgttggcgctgtctttggtgcaaaacgacaaatagaaaa

SEQ ID NO: 14 - protein, 540 aa, Actinobacillus pleuropneumoniae
MHFKSDLYIVALTSTFLVACSGGKGSFDLDDVQPNKAVEPEKTKVNYTDEETQKRKKEELDKLMEPALGYVTKIPVNIPSVRKTEISEIDTVTDESLSLVPNEDKLRTIANENAGSVVTKSGSNTMNFVRSGYTIDVVHYGLRDKGYVYYKGVHPSKELPKGNIIVYQGEWDFTSNADLDAKRPNYNPEFNGYGAGQRVGVTSADAKERTYISKFNIDFSNKKLNGQLLTKTKENQEKLRYTVEANISGNRFRGKATATDKTDPILGKDSEHLEGGLYGPKSEELAGKFVAHDKSLFAVFSGKRGNDVLETVKIIDASKIDLTTFESSELNNFGNANVLIIDGQKIDLAGADFKNRKTVDINGKTMVAIACCSNLEYMKFGQLWQKEGEQTKDNSLFLQGERTATDKIPVGGNYKYVGTWDALVSKGTNWVAEADNNRESGYRSEFDVNFGDKKVSGKLFDKGGIVPVFMINADIKGNGFTGTANTTDTGFALDSGSSQHGNAVFSDIKVNGGFYGPTAGELGGQFHHKSDNGSVGAVFG

SEQ ID NO: 15 - DNA, 1640 bp, Actinobacillus pleuropneumoniae
atgcattttaaatccgacctatatatagtagctcttacctcaactttccttgtagcttgttctggtggaaaaggtagctttgatttggatgatgttcaaccaaataaagccgttgaaccagaaaaaacaaaagtgaattataccgacgaagaaacacaaaaaaggaaaaaagaagagttagataagttgatggaacctgctttgggatatgtaacaaaaatcccagtcaatatacctagtgtaagaaaaacagaaatttcagaaattgatacagtgactgatgaatctctctctctcgttccaaatgaggacaaattaagaacaatcgctaacgagaattatgggtcggtagtaacaaaatctggaagtaacactatgaattttgttcgttctggatatacgattgatgttgttcatgctggtttaagagataaaggatatgtttactacaaaggagttcatccttccaaagagctccctaaaggcaatattatcgtttatcaaggagagtgggactttacctcaaatgccgatctagatgccaaaagaccaaattacaatcctgaatttaatggctatggcgcagggcaaagagttggagttacttctgcagatgcaaaagaaagaacttatatctcgaagttcaacatagatttttcaaataagaaattgaatggtcagttacttactaaaacaaaagaaaatcaagaaaaattacgctataccgttgaagctaacattagtggcaatcgttttagaggaaaagcgactgctactgataaaacagatccgatattaggtaaagattctgagcatcttgaaggtggcttatatggtccaaaatcagaagaacttgcaggaaaatttgtagctcatgataaatctctttttgcggtattctctggcaaaagaggtaatgacgttcttgaaacagtcaagatcattgatgcctcaaaaattgatttaactacttttgaatcatcggaactcaacaatttcggcaacgctaatgtgttaattattgatggacagaaaatagatctagcaggtgcagattttaaaaatagaaaaaccgttgatatcaatggtaagacaatggtagccatagcttgctgtagtaatttggaatatatgaaatttggtcaattatggcaaaaagagggcgaacaaactaaagataatagcttattcctgcaaggtgagcgtactgccacagataaaatacccgtaggtggaaactataaatatgtaggaacctgggatgcactcgtttcaaaaggaacgaactgggtagctgaggcggataataatcgagaatcgggctatcgctcagaatttgatgttaattttggtgataaaaaagtaagcggcaagttatttgataaagggggcatagtacctgtctttatgatcaacgcagatattaaaggtaacggctttactgggacagctaacactacagatacaggctttgcgttagattcaggctctagccaacacggaaatgcggtatttagtgatataaaagtcaatggtggcttctatggtccaaccgctggagaacttggcggacaattccatcataaatcagacaatggcagtgttggcgctgtctttggtgcaaaacgacaaatagaaaa

SEQ ID NO: 16 - protein, 540 aa, Actinobacillus pleuropneumoniae
MHFKSDLYIVALTSTFLVACSGGKGSFDLDDVQPNKAVEPEKTKVNYTDEETQKRKKEELDKLMEPALGYVTKIPVNIPSVRKTEISEIDTVTDESLSLVPNEDKLRTIANENAGSVVTKSGSNTMNFVRSGYTIDVVHAGLRDKGYVYYKGVHPSKELPKGNIIVYQGEWDFTSNADLDAKRPNYNPEFNGYGAGQRVGVTSADAKERTYISKFNIDFSNKKLNGQLLTKTKENQEKLRYTVEANISGNRFRGKATATDKTDPILGKDSEHLEGGLYGPKSEELAGKFVAHDKSLFAVFSGKRGNDVLETVKIIDASKIDLTTFESSELNNFGNANVLIIDGQKIDLAGADFKNRKTVDINGKTMVAIACCSNLEYMKFGQLWQKEGEQTKDNSLFLQGERTATDKIPVGGNYKYVGTWDALVSKGTNWVAEADNNRESGYRSEFDVNFGDKKVSGKLFDKGGIVPVFMINADIKGNGFTGTANTTDTGFALDSGSSQHGNAVFSDIKVNGGFYGPTAGELGGQFHHKSDNGSVGAVFG

SEQ ID NO: 17 - DNA, 1640 bp, Actinobacillus pleuropneumoniae
atgcattttaaatccgacctatatatagtagctcttacctcaactttccttgtagcttgttctggtggaaaaggtagctttgatttggatgatgttcaaccaaataaagccgttgaaccagaaaaaacaaaagtgaattataccgacgaagaaacacaaaaaaggaaaaaagaagagttagataagttgatggaacctgctttgggatatgtaacaaaaatcccagtcaatatacctagtgtaagaaaaacagaaatttcagaaattgatacagtgactgatgaatctctctctctcgttccaaatgaggacaaattaagaacaatcgctaacgagaattatgggtcggtagtaacaaaatctggaagtaacactatgaattttgttcgttctggatatacgattgatgttgttcattatggtttaagagataaaggatatgtttactacaaaggagttcatccttccaaagagctccctaaaggcaatattatcgtttatcaaggagagtgggactttacctcaaatgccgatctagatgccaaaagaccaaattacaatcctgaatttaatggcgcaggcgcagggcaaagagttggagttacttctgcagatgcaaaagaaagaacttatatctcgaagttcaacatagatttttcaaataagaaattgaatggtcagttacttactaaaacaaaagaaaatcaagaaaaattacgctataccgttgaagctaacattagtggcaatcgttttagaggaaaagcgactgctactgataaaacagatccgatattaggtaaagattctgagcatcttgaaggtggcttatatggtccaaaatcagaagaacttgcaggaaaatttgtagctcatgataaatctctttttgcggtattctctggcaaaagaggtaatgacgttcttgaaacagtcaagatcattgatgcctcaaaaattgatttaactacttttgaatcatcggaactcaacaatttcggcaacgctaatgtgttaattattgatggacagaaaatagatctagcaggtgcagattttaaaaatagaaaaaccgttgatatcaatggtaagacaatggtagccatagcttgctgtagtaatttggaatatatgaaatttggtcaattatggcaaaaagagggcgaacaaactaaagataatagcttattcctgcaaggtgagcgtactgccacagataaaatacccgtaggtggaaactataaatatgtaggaacctgggatgcactcgtttcaaaaggaacgaactgggtagctgaggcggataataatcgagaatcgggctatcgctcagaatttgatgttaattttggtgataaaaaagtaagcggcaagttatttgataaagggggcatagtacctgtctttatgatcaacgcagatattaaaggtaacggctttactgggacagctaacactacagatacaggctttgcgttagattcaggctctagccaacacggaaatgcggtatttagtgatataaaagtcaatggtggcttctatggtccaaccgctggagaacttggcggacaattccatcataaatcagacaatggcagtgttggcgctgtctttggtgcaaaacgacaaatagaaaa

SEQ ID NO: 18 - protein, 540 aa, Actinobacillus pleuropneumoniae
MHFKSDLYIVALTSTFLVACSGGKGSFDLDDVQPNKAVEPEKTKVNYTDEETQKRKKEELDKLMEPALGYVTKIPVNIPSVRKTEISEIDTVTDESLSLVPNEDKLRTIANENYGSVVTKSGSNTMNFVRSGYTIDVVHYGLRDKGYVYYKGVHPSKELPKGNIIVYQGEWDFTSNADLDAKRPNYNPEFNGAGAGQRVGVTSADAKERTYISKFNIDFSNKKLNGQLLTKTKENQEKLRYTVEANISGNRFRGKATATDKTDPILGKDSEHLEGGLYGPKSEELAGKFVAHDKSLFAVFSGKRGNDVLETVKIIDASKIDLTTFESSELNNFGNANVLIIDGQKIDLAGADFKNRKTVDINGKTMVAIACCSNLEYMKFGQLWQKEGEQTKDNSLFLQGERTATDKIPVGGNYKYVGTWDALVSKGTNWVAEADNNRESGYRSEFDVNFGDKKVSGKLFDKGGIVPVFMINADIKGNGFTGTANTTDTGFALDSGSSQHGNAVFSDIKVNGGFYGPTAGELGGQFHHKSDNGSVGAVFG

SEQ ID NO: 19 - DNA, 1640 bp, Actinobacillus pleuropneumoniae
atgcattttaaatccgacctatatatagtagctcttacctcaactttccttgtagcttgttctggtggaaaaggtagctttgatttggatgatgttcaaccaaataaagccgttgaaccagaaaaaacaaaagtgaattataccgacgaagaaacacaaaaaaggaaaaaagaagagttagataagttgatggaacctgctttgggatatgtaacaaaaatcccagtcaatatacctagtgtaagaaaaacagaaatttcagaaattgatacagtgactgatgaatctctctctctcgttccaaatgaggacaaattaagaacaatcgctaacgagaattatgggtcggtagtaacaaaatctggaagtaacactatgaattttgttcgttctggatatacgattgatgttgttcattatggtttaagagataaaggatatgtttactacaaaggagttcatccttccaaagagctccctaaaggcaatattatcgtttatcaaggagagtgggactttacctcaaatgccgatctagatgccaaaagaccaaattacaatcctgaatttaatggctatggcgcagggcaagaggttggagttacttctgcagatgcaaaagaaagaacttatatctcgaagttcaacatagatttttcaaataagaaattgaatggtcagttacttactaaaacaaaagaaaatcaagaaaaattacgctataccgttgaagctaacattagtggcaatcgttttagaggaaaagcgactgctactgataaaacagatccgatattaggtaaagattctgagcatcttgaaggtggcttatatggtccaaaatcagaagaacttgcaggaaaatttgtagctcatgataaatctctttttgcggtattctctggcaaaagaggtaatgacgttcttgaaacagtcaagatcattgatgcctcaaaaattgatttaactacttttgaatcatcggaactcaacaatttcggcaacgctaatgtgttaattattgatggacagaaaatagatctagcaggtgcagattttaaaaatagaaaaaccgttgatatcaatggtaagacaatggtagccatagcttgctgtagtaatttggaatatatgaaatttggtcaattatggcaaaaagagggcgaacaaactaaagataatagcttattcctgcaaggtgagcgtactgccacagataaaatacccgtaggtggaaactataaatatgtaggaacctgggatgcactcgtttcaaaaggaacgaactgggtagctgaggcggataataatcgagaatcgggctatcgctcagaatttgatgttaattttggtgataaaaaagtaagcggcaagttatttgataaagggggcatagtacctgtctttatgatcaacgcagatattaaaggtaacggctttactgggacagctaacactacagatacaggctttgcgttagattcaggctctagccaacacggaaatgcggtatttagtgatataaaagtcaatggtggcttctatggtccaaccgctggagaacttggcggacaattccatcataaatcagacaatggcagtgttggcgctgtctttggtgcaaaacgacaaatagaaaa

SEQ ID NO: 20 - protein, 540 aa, Actinobacillus pleuropneumoniae
MHFKSDLYIVALTSTFLVACSGGKGSFDLDDVQPNKAVEPEKTKVNYTDEETQKRKKEELDKLMEPALGYVTKIPVNIPSVRKTEISEIDTVTDESLSLVPNEDKLRTIANENYGSVVTKSGSNTMNFVRSGYTIDVVHYGLRDKGYVYYKGVHPSKELPKGNIIVYQGEWDFTSNADLDAKRPNYNPEFNGYGAGQEVGVTSADAKERTYISKFNIDFSNKKLNGQLLTKTKENQEKLRYTVEANISGNRFRGKATATDKTDPILGKDSEHLEGGLYGPKSEELAGKFVAHDKSLFAVFSGKRGNDVLETVKIIDASKIDLTTFESSELNNFGNANVLIIDGQKIDLAGADFKNRKTVDINGKTMVAIACCSNLEYMKFGQLWQKEGEQTKDNSLFLQGERTATDKIPVGGNYKYVGTWDALVSKGTNWVAEADNNRESGYRSEFDVNFGDKKVSGKLFDKGGIVPVFMINADIKGNGFTGTANTTDTGFALDSGSSQHGNAVFSDIKVNGGFYGPTAGELGGQFHHKSDNGSVGAVFG

SEQ ID NO: 21 - DNA, 730 bp, Actinobacillus pleuropneumoniae
aggtaatgacgttcttgaaacagtcaagatcattgatgcctcaaaaattgatttaactacttttgaatcatcggaactcaacaatttcggcaacgctaatgtgttaattattgatggacagaaaatagatctagcaggtgcagattttaaaaatagaaaaaccgttgatatcaatggtaagacaatggtagccatagcttgctgtagtaatttggaatatatgaaatttggtcaattatggcaaaaagagggcgaacaaactaaagataatagcttattcctgcaaggtgagcgtactgccacagataaaatacccgtaggtggaaactataaatatgtaggaacctgggatgcactcgtttcaaaaggaacgaactgggtagctgaggcggataataatcgagaatcgggctatcgctcagaatttgatgttaattttggtgataaaaaagtaagcggcaagttatttgataaagggggcatagtacctgtctttatgatcaacgcagatattaaaggtaacggctttactgggacagctaacactacagatacaggctttgcgttagattcaggctctagccaacacggaaatgcggtatttagtgatataaaagtcaatggtggcttctatggtccaaccgctggagaacttggcggacaattccatcataaatcagacaatggcagtgttggcgctgtctttggtgcaaaacgacaaatagaaaaa

SEQ ID NO: 22 - protein, 240 aa, Actinobacillus pleuropneumoniae
RGNDVLETVKIIDASKIDLTTFESSELNNFGNANVLIIDGQKIDLAGADFKNRKTVDINGKTMVAIACCSNLEYMKFGQLWQKEGEQTKDNSLFLQGERTATDKIPVGGNYKYVGTWDALVSKGTNWVAEADNNRESGYRSEFDVNFGDKKVSGKLFDKGGIVPVFMINADIKGNGFTGTANTTDTGFALDSGSSQHGNAVFSDIKVNGGFYGPTAGELGGQFHHKSDNGSVGAVFGAKR

SEQ ID NO: 23 - DNA, 910 bp, Actinobacillus pleuropneumoniae
atgcattttaaatccgacctatatatagtagctcttacctcaactttccttgtagcttgttctggtggaaaaggtagctttgatttggatgatgttcaaccaaataaagccgttgaaccagaaaaaacaaaagtgaattataccgacgaagaaacacaaaaaaggaaaaaagaagagttagataagttgatggaacctgctttgggatatgtaacaaaaatcccagtcaatatacctagtgtaagaaaaacagaaatttcagaaattgatacagtgactgatgaatctctctctctcgttccaaatgaggacaaattaagaacaatcgctaacgagaattatgggtcggtagtaacaaaatctggaagtaacactatgaattttgttcgttctggatatacgattgatgttgttcattatggtttaagagataaaggatatgtttactacaaaggagttcatccttccaaagagctccctaaaggcaatattatcgtttatcaaggagagtgggactttacctcaaatgccgatctagatgccaaaagaccaaattacaatcctgaatttaatggctatggcgcagggcaaagagttggagttacttctgcagatgcaaaagaaagaacttatatctcgaagttcaacatagatttttcaaataagaaattgaatggtcagttacttactaaaacaaaagaaaatcaagaaaaattacgctataccgttgaagctaacattagtggcaatcgttttagaggaaaagcgactgctactgataaaacagatccgatattaggtaaagattctgagcatcttgaaggtggcttatatggtccaaaatcagaagaacttgcaggaaaatttgtagctcatgataaatctctttttgcggtattctctggcaaaa

SEQ ID NO: 24 - protein, 280 aa, Actinobacillus pleuropneumoniae
CSGGKGSFDLDDVQPNKAVEPEKTKVNYTDEETQKRKKEELDKLMEPALGYVTKIPVNIPSVRKTEISEIDTVTDESLSLVPNEDKLRTIANENYGSVVTKSGSNTMNFVRSGYTIDVVHYGLRDKGYVYYKGVHPSKELPKGNIIVYQGEWDFTSNADLDAKRPNYNPEFNGYGAGQRVGVTSADAKERTYISKFNIDFSNKKLNGQLLTKTKENQEKLRYTVEANISGNRFRGKATATDKTDPILGKDSEHLEGGLYGPKSEELAGKFVAHDKSLFAV

SEQ ID NO: 25 - DNA, 615 bp, Actinobacillus pleuropneumoniae
ggatccaagttgatggaacctgctttgggatatgtaacaaaaatcccagtcggtccgggtagcgaaatttcagaaattgatacagtgactgatgaatctgtgtctggtgcgccgggtgttgttaactctggatatacgattgatgttgttcattatggtttaagagataaaggttctgtgtcttataaaggagttcatccttccaaagagctccctaaaggcaatattatcgtttatcaaggagagtgggactttacctcaaatgccggtgcggcgggtagagttggagttacttctgcagatgcaaaagaaagaacttatatctcgaagttcaacatagatttttcaaataagaaattgaatggtcagttacttactaaaacaaaagaaaatcaagaaaaattacgctataccgttgaagctaacattagtggcaatcgttttagaggaaaagcgactgctactgataaaacagatccgatattaggtaaagattctgagcatcttgaaggtggcttatatggtccaaaatcagaagaacttgcaggaaaatttgtagctcatgataaatctctttttgcggtattctctggcaaaagaggtaatgacgttctt

SEQ ID NO: 26 - protein, 205 aa, Actinobacillus pleuropneumoniae
GSKLMEPALGYVTKIPVGPGSEISEIDTVTDESVSGAPGVVNSGYTIDVVHYGLRDKGSVSYKGVHPSKELPKGNIIVYQGEWDFTSNAGAAGRVGVTSADAKERTYISKFNIDFSNKKLNGQLLTKTKENQEKLRYTVEANISGNRFRGKATATDKTDPILGKDSEHLEGGLYGPKSEELAGKFVAHDKSLFAVFSGKRGNDVL

SEQ ID NO: 27 - DNA, 1790 bp, Actinobacillus suis
atgcattttaaacttaatccctatgcgttagcgtttacttcgctgtttcttgtcgcttgttctggcggaaaaggaggttttgatttagaagatgttcggccaaatcaaactgcaaaagcagaaaaagcaacaacctcttatcaagatgaggaaacgaagaaaaagacaaaggaagaattagataagttgatggagcctactttgggagttgaggcaaagatacctcgccggaatagagctttatttgataaagaaggaaatcgaaaagcaacacctgatacaactgatgaattatctgaagcacaaattatggcgatttggaatgaaaatatagatgaaattcctcacttgaaagagttaaacgataaaacaacgagtggtttaatttatcactctcacgatggtaaacaggaggacaaaaaacgaaatttacaatatgtgcgttcaggctatgttttcgatgaatcttatagtgaaatagtaaaaaataagaatggtgtaccctatatttttaaaaatgggatcgatggttacatttactatttagggacaagcccgtcaaaagaactccctaaaggaaataaagttacctataaaggtacttgggatttcaccagcgatgttaaaacaagctacgagttaagtggatttagtgatgctggtaatggtaaaaatgttgcagctacatctatttcggataatgtcaatcgagatcataaagttggtgaaaaactaggtgataatgaagttaaaggggtagctcattctagtgaatttgcagtagattttgataacaaaaaattgacaggtagtttatatcgtaatggttatatcaacagaaataaagcgcaagaagtaacgaaacgctatagcattgaagctgatataacaggcaaccggtttacaggaaaagccaaagcagaaaaagcaggtgatccgatctttactgattcaaattatcttgaagggggattctatggtcctaaagctgaagaaatggcagggaaatttttcacaaataataaatctctctttgcagtatttgcagctaaaagtgaaaacggcgagacgaccacagaacgaatcattgatgcaactaaaattgatttaacccaatttaatgctaaagaactcaacaattttggtgatgcctctgttttaattattgatggacaaaaaatagatctagcaggtgtcaattttaaaaatagtaaaacggttgaaatcaacggcaaaacaatggtagccgtagcttgctgtagtaatctggaatatatgaaatttggtcaattgtggcaaaaagagggcaaacaacaagttaaagataatagtttattcctacaaggtgaacgtactgcaacggataaaatgcccgcaggaggtaactataagtatgttggaacttgggatgcactcgtatctaaagggacgaactggatagcggaagcagataataatcgagaatcgggctatcgcactgaatttgatgttaattttagtgataaaaaagtaaacggtaagttatttgataaaggcggtgtaaatcctgtatttaccgtagatgcgacaattaatggtaatggctttatcggcagtgcgaaaacctctgatagtggctttgctttagatgcaggctctagccaacacggaaatgcggtatttagtgatataaaagtcaatggtggcttctatggtccaaccgctggagaacttggcggacaattccatcataaatcagacaatggcagtgttggcgctgtctttggtgcaaaacgacaaatagaaaaata

SEQ ID NO: 28 - protein, 590 aa, Actinobacillus suis
MHFKLNPYALAFTSLFLVACSGGKGGFDLEDVRPNQTAKAEKATTSYQDEETKKKTKEELDKLMEPTLGVEAKIPRRNRALFDKEGNRKATPDTTDELSEAQIMAIWNENIDEIPHLKELNDKTTSGLIYHSHDGKQEDKKRNLQYVRSGYVFDESYSEIVKNKNGVPYIFKNGIDGYIYYLGTSPSKELPKGNKVTYKGTWDFTSDVKTSYELSGFSDAGNGKNVAATSISDNVNRDHKVGEKLGDNEVKGVAHSSEFAVDFDNKKLTGSLYRNGYINRNKAQEVTKRYSIEADITGNRFTGKAKAEKAGDPIFTDSNYLEGGFYGPKAEEMAGKFFTNNKSLFAVFAAKSENGETTTERIIDATKIDLTQFNAKELNNFGDASVLIIDGQKIDLAGVNFKNSKTVEINGKTMVAVACCSNLEYMKFGQLWQKEGKQQVKDNSLFLQGERTATDKMPAGGNYKYVGTWDALVSKGTNWIAEADNNRESGYRTEFDVNFSDKKVNGKLFDKGGVNPVFTVDATINGNGFIGSAKTSDSGFALDAGSSQHGNAVFSDIKVNGGFYGPTAGELGGQFHHKSDNGSVGAVFGA

SEQ ID NO: 29 - DNA, 1790 bp, Actinobacillus suis
atgcattttaaacttaatccctatgcgttagcgtttacttcgctgtttcttgtcgcttgttctggcggaaaaggaggttttgatttagaagatgttcggccaaatcaaactgcaaaagcagaaaaagcaacaacctcttatcaagatgaggaaacgaagaaaaagacaaaggaagaattagataagttgatggagcctactttgggagttgaggcaaagatacctcgccggaatagagctttagcagataaagaaggaaatcgaaaagcaacacctgatacaactgatgaattatctgaagcacaaattatggcgatttggaatgaaaatatagatgaaattcctcacttgaaagagttaaacgataaaacaacgagtggtttaatttatcactctcacgatggtaaacaggaggacaaaaaacgaaatttacaatatgtgcgttcaggctatgttttcgatgaatcttatagtgaaatagtaaaaaataagaatggtgtaccctatatttttaaaaatgggatcgatggttacatttactatttagggacaagcccgtcaaaagaactccctaaaggaaataaagttacctataaaggtacttgggatttcaccagcgatgttaaaacaagctacgagttaagtggatttagtgatgctggtaatggtaaaaatgttgcagctacatctatttcggataatgtcaatcgagatcataaagttggtgaaaaactaggtgataatgaagttaaaggggtagctcattctagtgaatttgcagtagattttgataacaaaaaattgacaggtagtttatatcgtaatggttatatcaacagaaataaagcgcaagaagtaacgaaacgctatagcattgaagctgatataacaggcaaccggtttacaggaaaagccaaagcagaaaaagcaggtgatccgatctttactgattcaaattatcttgaagggggattctatggtcctaaagctgaagaaatggcagggaaatttttcacaaataataaatctctctttgcagtatttgcagctaaaagtgaaaacggcgagacgaccacagaacgaatcattgatgcaactaaaattgatttaacccaatttaatgctaaagaactcaacaattttggtgatgcctctgttttaattattgatggacaaaaaatagatctagcaggtgtcaattttaaaaatagtaaaacggttgaaatcaacggcaaaacaatggtagccgtagcttgctgtagtaatctggaatatatgaaatttggtcaattgtggcaaaaagagggcaaacaacaagttaaagataatagtttattcctacaaggtgaacgtactgcaacggataaaatgcccgcaggaggtaactataagtatgttggaacttgggatgcactcgtatctaaagggacgaactggatagcggaagcagataataatcgagaatcgggctatcgcactgaatttgatgttaattttagtgataaaaaagtaaacggtaagttatttgataaaggcggtgtaaatcctgtatttaccgtagatgcgacaattaatggtaatggctttatcggcagtgcgaaaacctctgatagtggctttgctttagatgcaggctctagccaacacggaaatgcggtatttagtgatataaaagtcaatggtggcttctatggtccaaccgctggagaacttggcggacaattccatcataaatcagacaatggcagtgttggcgctgtctttggtgcaaaacgacaaatagaaaaata

SEQ ID NO: 30 - protein, 590 aa, Actinobacillus suis
MHFKLNPYALAFTSLFLVACSGGKGGFDLEDVRPNQTAKAEKATTSYQDEETKKKTKEELDKLMEPTLGVEAKIPRRNRALADKEGNRKATPDTTDELSEAQIMAIWNENIDEIPHLKELNDKTTSGLIYHSHDGKQEDKKRNLQYVRSGYVFDESYSEIVKNKNGVPYIFKNGIDGYIYYLGTSPSKELPKGNKVTYKGTWDFTSDVKTSYELSGFSDAGNGKNVAATSISDNVNRDHKVGEKLGDNEVKGVAHSSEFAVDFDNKKLTGSLYRNGYINRNKAQEVTKRYSIEADITGNRFTGKAKAEKAGDPIFTDSNYLEGGFYGPKAEEMAGKFFTNNKSLFAVFAAKSENGETTTERIIDATKIDLTQFNAKELNNFGDASVLIIDGQKIDLAGVNFKNSKTVEINGKTMVAVACCSNLEYMKFGQLWQKEGKQQVKDNSLFLQGERTATDKMPAGGNYKYVGTWDALVSKGTNWIAEADNNRESGYRTEFDVNFSDKKVNGKLFDKGGVNPVFTVDATINGNGFIGSAKTSDSGFALDAGSSQHGNAVFSDIKVNGGFYGPTAGELGGQFHHKSDNGSVGAVFGA

SEQ ID NO: 31 - DNA, 1790 bp, Actinobacillus suis
atgcattttaaacttaatccctatgcgttagcgtttacttcgctgtttcttgtcgcttgttctggcggaaaaggaggttttgatttagaagatgttcggccaaatcaaactgcaaaagcagaaaaagcaacaacctcttatcaagatgaggaaacgaagaaaaagacaaaggaagaattagataagttgatggagcctactttgggagttgaggcaaagatacctcgccggaatagagctttatttgataaagaaggaaatcgaaaagcaacacctgatacaactgatgaattatctgaagcacaaattatggcgatttggaatgaaaatatagatgaaattcctcacttgaaagagttaaacgataaaacaacgagtggtttaatttatcactctcacgatggtaaacaggaggacaaaaaacgaaatttacaatatgtgcgttcaggctatgttttcgatgaatcttatagtgaaatagtaaaaaataagaatggtgtaccctatattgcaaaaaatgggatcgatggttacatttactatttagggacaagcccgtcaaaagaactccctaaaggaaataaagttacctataaaggtacttgggatttcaccagcgatgttaaaacaagctacgagttaagtggatttagtgatgctggtaatggtaaaaatgttgcagctacatctatttcggataatgtcaatcgagatcataaagttggtgaaaaactaggtgataatgaagttaaaggggtagctcattctagtgaatttgcagtagattttgataacaaaaaattgacaggtagtttatatcgtaatggttatatcaacagaaataaagcgcaagaagtaacgaaacgctatagcattgaagctgatataacaggcaaccggtttacaggaaaagccaaagcagaaaaagcaggtgatccgatctttactgattcaaattatcttgaagggggattctatggtcctaaagctgaagaaatggcagggaaatttttcacaaataataaatctctctttgcagtatttgcagctaaaagtgaaaacggcgagacgaccacagaacgaatcattgatgcaactaaaattgatttaacccaatttaatgctaaagaactcaacaattttggtgatgcctctgttttaattattgatggacaaaaaatagatctagcaggtgtcaattttaaaaatagtaaaacggttgaaatcaacggcaaaacaatggtagccgtagcttgctgtagtaatctggaatatatgaaatttggtcaattgtggcaaaaagagggcaaacaacaagttaaagataatagtttattcctacaaggtgaacgtactgcaacggataaaatgcccgcaggaggtaactataagtatgttggaacttgggatgcactcgtatctaaagggacgaactggatagcggaagcagataataatcgagaatcgggctatcgcactgaatttgatgttaattttagtgataaaaaagtaaacggtaagttatttgataaaggcggtgtaaatcctgtatttaccgtagatgcgacaattaatggtaatggctttatcggcagtgcgaaaacctctgatagtggctttgctttagatgcaggctctagccaacacggaaatgcggtatttagtgatataaaagtcaatggtggcttctatggtccaaccgctggagaacttggcggacaattccatcataaatcagacaatggcagtgttggcgctgtctttggtgcaaaacgacaaatagaaaaata

SEQ ID NO: 32 - protein, 590 aa, Actinobacillus suis
MHFKLNPYALAFTSLFLVACSGGKGGFDLEDVRPNQTAKAEKATTSYQDEETKKKTKEELDKLMEPTLGVEAKIPRRNRALFDKEGNRKATPDTTDELSEAQIMAIWNENIDEIPHLKELNDKTTSGLIYHSHDGKQEDKKRNLQYVRSGYVFDESYSEIVKNKNGVPYIAKNGIDGYIYYLGTSPSKELPKGNKVTYKGTWDFTSDVKTSYELSGFSDAGNGKNVAATSISDNVNRDHKVGEKLGDNEVKGVAHSSEFAVDFDNKKLTGSLYRNGYINRNKAQEVTKRYSIEADITGNRFTGKAKAEKAGDPIFTDSNYLEGGFYGPKAEEMAGKFFTNNKSLFAVFAAKSENGETTTERIIDATKIDLTQFNAKELNNFGDASVLIIDGQKIDLAGVNFKNSKTVEINGKTMVAVACCSNLEYMKFGQLWQKEGKQQVKDNSLFLQGERTATDKMPAGGNYKYVGTWDALVSKGTNWIAEADNNRESGYRTEFDVNFSDKKVNGKLFDKGGVNPVFTVDATINGNGFIGSAKTSDSGFALDAGSSQHGNAVFSDIKVNGGFYGPTAGELGGQFHHKSDNGSVGAVFGA

SEQ ID NO: 33 - DNA, 730 bp, Actinobacillus suis
tgaaaacggcgagacgaccacagaacgaatcattgatgcaactaaaattgatttaacccaatttaatgctaaagaactcaacaattttggtgatgcctctgttttaattattgatggacaaaaaatagatctagcaggtgtcaattttaaaaatagtaaaacggttgaaatcaacggcaaaacaatggtagccgtagcttgctgtagtaatctggaatatatgaaatttggtcaattgtggcaaaaagagggcaaacaacaagttaaagataatagtttattcctacaaggtgaacgtactgcaacggataaaatgcccgcaggaggtaactataagtatgttggaacttgggatgcactcgtatctaaagggacgaactggatagcggaagcagataataatcgagaatcgggctatcgcactgaatttgatgttaattttagtgataaaaaagtaaacggtaagttatttgataaaggcggtgtaaatcctgtatttaccgtagatgcgacaattaatggtaatggctttatcggcagtgcgaaaacctctgatagtggctttgctttagatgcaggctctagccaacacggaaatgcggtatttagtgatataaaagtcaatggtggcttctatggtccaaccgctggagaacttggcggacaattccatcataaatcagacaatggcagtgttggcgctgtctttggtgcaaaacgacaaatagaa

SEQ ID NO: 34 - protein, 240 aa, Actinobacillus suis
SENGETTTERIIDATKIDLTQFNAKELNNFGDASVLIIDGQKIDLAGVNFKNSKTVEINGKTMVAVACCSNLEYMKFGQLWQKEGKQQVKDNSLFLQGERTATDKMPAGGNYKYVGTWDALVSKGTNWIAEADNNRESGYRTEFDVNFSDKKVNGKLFDKGGVNPVFTVDATINGNGFIGSAKTSDSGFALDAGSSQHGNAVFSDIKVNGGFYGPTAGELGGQFHHKSDNGSVGAVFGAK

SEQ ID NO: 35 - DNA, 1050 bp, Actinobacillus suis
atgcattttaaacttaatccctatgcgttagcgtttacttcgctgtttcttgtcgcttgttctggcggaaaaggaggttttgatttagaagatgttcggccaaatcaaactgcaaaagcagaaaaagcaacaacctcttatcaagatgaggaaacgaagaaaaagacaaaggaagaattagataagttgatggagcctactttgggagttgaggcaaagatacctcgccggaatagagctttatttgataaagaaggaaatcgaaaagcaacacctgatacaactgatgaattatctgaagcacaaattatggcgatttggaatgaaaatatagatgaaattcctcacttgaaagagttaaacgataaaacaacgagtggtttaatttatcactctcacgatggtaaacaggaggacaaaaaacgaaatttacaatatgtgcgttcaggctatgttttcgatgaatcttatagtgaaatagtaaaaaataagaatggtgtaccctatatttttaaaaatgggatcgatggttacatttactatttagggacaagcccgtcaaaagaactccctaaaggaaataaagttacctataaaggtacttgggatttcaccagcgatgttaaaacaagctacgagttaagtggatttagtgatgctggtaatggtaaaaatgttgcagctacatctatttcggataatgtcaatcgagatcataaagttggtgaaaaactaggtgataatgaagttaaaggggtagctcattctagtgaatttgcagtagattttgataacaaaaaattgacaggtagtttatatcgtaatggttatatcaacagaaataaagcgcaagaagtaacgaaacgctatagcattgaagctgatataacaggcaaccggtttacaggaaaagccaaagcagaaaaagcaggtgatccgatctttactgattcaaattatcttgaagggggattctatggtcctaaagctgaagaaatggcagggaaatttttcacaaataataaatctctctttgcagtatttgcagct

SEQ ID NO: 36 - protein, 330 aa, Actinobacillus suis
CSGGKGGFDLEDVRPNQTAKAEKATTSYQDEETKKKTKEELDKLMEPTLGVEAKIPRRNRALFDKEGNRKATPDTTDELSEAQIMAIWNENIDEIPHLKELNDKTTSGLIYHSHDGKQEDKKRNLQYVRSGYVFDESYSEIVKNKNGVPYIFKNGIDGYIYYLGTSPSKELPKGNKVTYKGTWDFTSDVKTSYELSGFSDAGNGKNVAATSISDNVNRDHKVGEKLGDNEVKGVAHSSEFAVDFDNKKLTGSLYRNGYINRNKAQEVTKRYSIEADITGNRFTGKAKAEKAGDPIFTDSNYLEGGFYGPKAEEMAGKFFTNNKSLFAVFA

SEQ ID NO: 37 - DNA, 675 bp, Actinobacillus suis
ggatccaagttgatggagcctactttgggagttgaggcaaagatacctcgccggggtgcagcgacaactgatgaattatctcaaattatggcgatttggaatgaaaatatagatgaaattcctcacttgaaagagttaaacgataaaacaacgagtggtttaatttatcactctgcgggttctaatttacaatatgtgcgttcaggctatgttttcgatgaatctccgggtgggatcgatggttacatttactatttagggacaagcccgtcaaaagaactccctaaaggaaataaagttacctataaaggtacttgggatttcaccagcgatgttaaaggtaaaaatgttgcagctacatctatttcggataatgtcggtgctggtcattctagtgaatttgcagtagattttgataacaaaaaattgacaggtagtttatatcgtaatccgggtgcggtaacgaaacgctatagcattgaagctgatataacaggcaaccgttttagaggaaaagccaaagcagaaaaagcaggtgatccgatctttactgattcaaattatcttgaagggggattctatggtcctaaagctgaagaaatggcagggaaatttttcacaaataataaatctctctttgcagtatttgcagctaaaagtgaaaacggcgagacg

SEQ ID NO: 38 - protein, 195 aa, Actinobacillus suis
GSKLMEPTLGVEAKIPRRGAATTDELSQIMAIWNENIDEIPHLKELNDKTTSGLIYHSAGSNLQYVRSGYVFDESPGGIDGYIYYLGTSPSKELPKGNKVTYKGTWDFTSDVKGKNVAATSISDNVGAGHSSEFAVDFDNKKLTGSLYRNPIFTDSNYLEGGFYGPKAEEMAGKFFTNNKSLFAVFAAKSENGET

SEQ ID NO: 39 - DNA, 2154 bp, Actinobacillus pleuropneumoniae
  misc_feature: Organism: Actinobacillus suis (as well)
gacaccgttcgtattattgatgcctcaaaaattgatttaactaatttcagcatttcagaacttaacaattttggtgatgcttccgttttaattattgatgggaaaaaaataaagctagctggtagcgggtttacaaataagcacactattgaaatcaatggcaaaacaatggtagccgtagcctgctgtagtaatctggaatatatgaagtttggtcaattatggcaacaagcagagggcggaaaacccgagaataatagtttattcctacaaggcgaacgtaccgcaacagataagatgccaaaaggcggaaactataaatatattggtacttgggatgctcaggtttcaaaagaaaataactgggttgctacggcagatgatgatagaaaagctggctatcgcacagaatttgatgttgattttggcaacaaaaatttaagtggtaagttatttgataaaaacggtgtaaatcctgtgtttaccgtagatgcaaaaattgatggtaatggttttactggcaaagctaaaacctcagatgctggtttcgctctagattcaggtagttcacgttatgagaatgtgaaatttaacgatgtagcagttagtggtggcttctatggtccaacggcagcagagcttggcggacaattccaccataaatcagaaaatggcagtgtaggtgctgtctttggtgcaaaacaacaagtaaaaaaacttgaaacagtcaagatcattgatgcctcaaaaattgatttaactacttttgaatcatcggaactcaacaatttcggcaacgctaatgtgttaattattgatggacagaaaatagatctagcaggtgcagattttaaaaatagaaaaaccgttgatatcaatggtaagacaatggtagccatagcttgctgtagtaatttggaatatatgaaatttggtcaattatggcaaaaagagggcgaacaaactaaagataatagcttattcctgcaaggtgagcgtactgccacagataaaatacccgtaggtggaaactataaatatgtaggaacctgggatgcactcgtttcaaaaggaacgaactgggtagctgaggcggataataatcgagaatcgggctatcgctcagaatttgatgttaattttggtgataaaaaagtaagcggcaagttatttgataaagggggcatagtacctgtctttatgatcaacgcagatattaaaggtaacggctttactgggacagctaacactacagatacaggctttgcgttagattcaggctctagccaacacggaaatgcggtatttagtgatataaaagtcaatggtggcttctatggtccaaccgctggagaacttggcggacaattccatcataaatcagacaatggcagtgttggcgctgtctttggtgcaaaacgacaaatagaaaaaacgaccacagaacgaatcattgatgcaactaaaattgatttaacccaatttaatgctaaagaactcaacaattttggtgatgcctctgttttaattattgatggacaaaaaatagatctagcaggtgtcaattttaaaaatagtaaaacggttgaaatcaacggcaaaacaatggtagccgtagcttgctgtagtaatctggaatatatgaaatttggtcaattgtggcaaaaagagggcaaacaacaagttaaagataatagtttattcctacaaggtgaacgtactgcaacggataaaatgcccgcaggaggtaactataagtatgttggaacttgggatgcactcgtatctaaagggacgaactggatagcggaagcagataataatcgagaatcgggctatcgcactgaatttgatgttaattttagtgataaaaaagtaaacggtaagttatttgataaaggcggtgtaaatcctgtatttaccgtagatgcgacaattaatggtaatggctttatcggcagtgcgaaaacctctgatagtggctttgctttagatgcaggctctagccaacacggaaatgcggtatttagtgatataaaagtcaatggtggcttctatggtccaaccgctggagaacttggcggacaattccatcataaatcagacaatggcagtgttggcgctgtctttggtgcaaaacgacaaatagaaaaa

SEQ ID NO: 40 - protein, 718 aa, Actinobacillus pleuropneumoniae
  MISC_FEATURE: Organism: Actinobacillus suis (as well)
DTVRIIDASKIDLTNFSISELNNFGDASVLIIDGKKIKLAGSGFTNKHTIEINGKTMVAVACCSNLEYMKFGQLWQQAEGGKPENNSLFLQGERTATDKMPKGGNYKYIGTWDAQVSKENNWVATADDDRKAGYRTEFDVDFGNKNLSGKLFDKNGVNPVFTVDAKIDGNGFTGKAKTSDAGFALDSGSSRYENVKFNDVAVSGGFYGPTAAELGGQFHHKSENGSVGAVFGAKQQVKKLETVKIIDASKIDLTTFESSELNNFGNANVLIIDGQKIDLAGADFKNRKTVDINGKTMVAIACCSNLEYMKFGQLWQKEGEQTKDNSLFLQGERTATDKIPVGGNYKYVGTWDALVSKGTNWVAEADNNRESGYRSEFDVNFGDKKVSGKLFDKGGIVPVFMINADIKGNGFTGTANTTDTGFALDSGSSQHGNAVFSDIKVNGGFYGPTAGELGGQFHHKSDNGSVGAVFGAKRQIEKTTTERIIDATKIDLTQFNAKELNNFGDASVLIIDGQKIDLAGVNFKNSKTVEINGKTMVAVACCSNLEYMKFGQLWQKEGKQQVKDNSLFLQGERTATDKMPAGGNYKYVGTWDALVSKGTNWIAEADNNRESGYRTEFDVNFSDKKVNGKLFDKGGVNPVFTVDATINGNGFIGSAKTSDSGFALDAGSSQHGNAVFSDIKVNGGFYGPTAGELGGQFHHKSDNGSVGAVFGAKRQIEK

SEQ ID NO: 41 - DNA, 51 bp, Actinobacillus pleuropneumoniae
aaagttccggtgagttcttttgaaaataagaaagttgatatttcagatata

SEQ ID NO: 42 - protein, 17 aa, Actinobacillus pleuropneumoniae
KVPVSSFENKKVDISDI

SEQ ID NO: 43 - DNA, 27 bp, Actinobacillus pleuropneumoniae
acgaacggaaatttagacgatgtgccg

SEQ ID NO: 44 - protein, 9 aa, Actinobacillus pleuropneumoniae
TNGNLDDVP

SEQ ID NO: 45 - DNA, 12 bp, Actinobacillus pleuropneumoniae
aaatataactat

SEQ ID NO: 46 - protein, 4 aa, Actinobacillus pleuropneumoniae
KYNY

SEQ ID NO: 47 - DNA, 27 bp, Actinobacillus pleuropneumoniae
aaaacaaaagattcttctcttcagtac

SEQ ID NO: 48 - protein, 9 aa, Actinobacillus pleuropneumoniae
KTKDSSLQY

SEQ ID NO: 49 - DNA, 30 bp, Actinobacillus pleuropneumoniae
gatggggaacactctggttctaatgaaaag

SEQ ID NO: 50 - protein, 10 aa, Actinobacillus pleuropneumoniae
DGEHSGSNEK

SEQ ID NO: 51 - DNA, 18 bp, Actinobacillus pleuropneumoniae
ggtaattcacctgcaaaa

SEQ ID NO: 52 - protein, 6 aa, Actinobacillus pleuropneumoniae
GNSPAK

SEQ ID NO: 53 - DNA, 15 bp, Actinobacillus pleuropneumoniae
cccgttaatcagctt

SEQ ID NO: 54 - protein, 5 aa, Actinobacillus pleuropneumoniae
PVNQL

SEQ ID NO: 55 - DNA, 123 bp, Actinobacillus pleuropneumoniae
tccaatgcaaatttaaataatgaagagggaagacctaattatttaaacgacgattattatactaaatttataggtaaacgggtgggcttggtttcgggagatgcgaaacctgcaaagcataaa

SEQ ID NO: 56 - protein, 41 aa, Actinobacillus pleuropneumoniae
SNANLNNEEGRPNYLNDDYYTKFIGKRVGLVSGDAKPAKHK

SEQ ID NO: 57 - DNA, 18 bp, Actinobacillus pleuropneumoniae
gattttgcaactaaaaaa

SEQ ID NO: 58 - protein, 6 aa, Actinobacillus pleuropneumoniae
DFATKK

SEQ ID NO: 59 - DNA, 12 bp, Actinobacillus pleuropneumoniae
gataaagagaaa

SEQ ID NO: 60 - protein, 4 aa, Actinobacillus pleuropneumoniae
DKEK

SEQ ID NO: 61 - DNA, 12 bp, Actinobacillus pleuropneumoniae
agaggcaatcgt

SEQ ID NO: 62 - protein, 4 aa, Actinobacillus pleuropneumoniae
RGNR

SEQ ID NO: 63 - DNA, 54 bp, Actinobacillus pleuropneumoniae
gcgagtgataaaaataaagggaaaggcgaatcatataacttctttagtgccgat

SEQ ID NO: 64 - protein, 18 aa, Actinobacillus pleuropneumoniae
ASDKNKGKGESYNFFSAD

SEQ ID NO: 65 - DNA, 21 bp, Actinobacillus pleuropneumoniae
tatggtccaaaagcagaagaa

SEQ ID NO: 66 - protein, 7 aa, Actinobacillus pleuropneumoniae
YGPKAEE

SEQ ID NO: 67 - DNA, 21 bp, Actinobacillus pleuropneumoniae
gtagctaacgacaaatctctt

SEQ ID NO: 68 - protein, 7 aa, Actinobacillus pleuropneumoniae
VANDKSL

SEQ ID NO: 69 - DNA, 21 bp, Actinobacillus pleuropneumoniae
cacaatggctctaatgttgac

SEQ ID NO: 70 - protein, 7 aa, Actinobacillus pleuropneumoniae
HNGSNVD

SEQ ID NO: 71 - DNA, 6 bp, Actinobacillus pleuropneumoniae
cgtatt

SEQ ID NO: 72 - protein, 2 aa, Actinobacillus pleuropneumoniae
RI

SEQ ID NO: 73 - DNA, 15 bp, Actinobacillus pleuropneumoniae
gatttaactaatttc

SEQ ID NO: 74 - protein, 5 aa, Actinobacillus pleuropneumoniae
DLTNF

SEQ ID NO: 75 - DNA, 27 bp, Actinobacillus pleuropneumoniae
gaacttaacaattttggtgatgcttcc

SEQ ID NO: 76 - protein, 9 aa, Actinobacillus pleuropneumoniae
ELNNFGDAS

SEQ ID NO: 77 - DNA, 9 bp, Actinobacillus pleuropneumoniae
attgatggg

SEQ ID NO: 78 - protein, 3 aa, Actinobacillus pleuropneumoniae
IDG

SEQ ID NO: 79 - DNA, 24 bp, Actinobacillus pleuropneumoniae
aagctagctggtagcgggtttaca

SEQ ID NO: 80 - protein, 8 aa, Actinobacillus pleuropneumoniae
KLAGSGFT

SEQ ID NO: 81 - DNA, 12 bp, Actinobacillus pleuropneumoniae
atcaatggcaaa

SEQ ID NO: 82 - protein, 4 aa, Actinobacillus pleuropneumoniae
INGK

SEQ ID NO: 83 - DNA, 24 bp, Actinobacillus pleuropneumoniae
tgctgtagtaatctggaatatatg

SEQ ID NO: 84 - protein, 8 aa, Actinobacillus pleuropneumoniae
CCSNLEYM

SEQ ID NO: 85 - DNA, 24 bp, Actinobacillus pleuropneumoniae
caacaagcagagggcggaaaaccc

SEQ ID NO: 86 - protein, 8 aa, Actinobacillus pleuropneumoniae
QQAEGGKP

SEQ ID NO: 87 - DNA, 42 bp, Actinobacillus pleuropneumoniae
ggcgaacgtaccgcaacagataagatgccaaaaggcggaaac

SEQ ID NO: 88 - protein, 14 aa, Actinobacillus pleuropneumoniae
GERTATDKMPKGGN

SEQ ID NO: 89 - DNA, 15 bp, Actinobacillus pleuropneumoniae
tcaaaagaaaataac

SEQ ID NO: 90 - protein, 5 aa, Actinobacillus pleuropneumoniae
SKENN

SEQ ID NO: 91 - DNA, 36 bp, Actinobacillus pleuropneumoniae
gctacggcagatgatgatagaaaagctggctatcgc

SEQ ID NO: 92 - protein, 12 aa, Actinobacillus pleuropneumoniae
ATADDDRKAGYR

SEQ ID NO: 93 - DNA, 18 bp, Actinobacillus pleuropneumoniae
gattttggcaacaaaaat

SEQ ID NO: 94 - protein, 6 aa, Actinobacillus pleuropneumoniae
DFGNKN

SEQ ID NO: 95 - DNA, 33 bp, Actinobacillus pleuropneumoniae
ttatttgataaaaacggtgtaaatcctgtgttt

SEQ ID NO: 96 - protein, 11 aa, Actinobacillus pleuropneumoniae
LFDKNGVNPVF

SEQ ID NO: 97 - DNA, 12 bp, Actinobacillus pleuropneumoniae
gatggtaatggt

SEQ ID NO: 98 - protein, 4 aa, Actinobacillus pleuropneumoniae
DGNG

SEQ ID NO: 99 - DNA, 69 bp, Actinobacillus pleuropneumoniae
aaaacctcagatgctggtttcgctctagattcaggtagttcacgttatgagaatgtgaaatttaacgat

SEQ ID NO: 100 - protein, 23 aa, Actinobacillus pleuropneumoniae
KTSDAGFALDSGSSRYENVKFND

SEQ ID NO: 101 - DNA, 12 bp, Actinobacillus pleuropneumoniae
tatggtccaacg

SEQ ID NO: 102 - protein, 4 aa, Actinobacillus pleuropneumoniae
YGPT

SEQ ID NO: 103 - DNA, 12 bp, Actinobacillus pleuropneumoniae
tcagaaaatggc

SEQ ID NO: 104 - protein, 4 aa, Actinobacillus pleuropneumoniae
SENG

SEQ ID NO: 105 - DNA, 6 bp, Actinobacillus pleuropneumoniae
aaaaaa

SEQ ID NO: 106 - protein, 2 aa, Actinobacillus pleuropneumoniae
KK

SEQ ID NO: 107 - protein, 540 aa, Haemophilus parasuis
MHFKLNPYALAFTSLFLVACSGGKGSFDLEDVQPNKTTGMSKEEYKDVETAKKEKEQLGELMEPALGYVVKVPVSQNGVRRTEISNLEAITDEDLNKIPNHDIIKDVAYQNYGELVDKTAAKKMTYVRSGYAIDVFHYGTRDKGYVFYKGITPSKELPQGPVLTYQGEWDFTSDANLDAKRPNSNPEFNGYGPGQRIAATSADAKGRTYTSEFEVDFSTKKLKGKLSSKTANAESLERYSIEAELKGNRFRGKAIAKNDSDASLGKSSDNLEGGFYGPKAEELAGKFITNDKSLFAVFSAKHNGSNVDTVRIIDASKIDLTNFSISELTNFGDASVLIIDGQKMELAGSGFTNKHTIEINGKTMVAVACCSNLEYMKFGQLWQQAEGEKAKDNSLFLQGERTATDKMPKGGNYKYIGTWDAQVSKENNWVATADDDRKAGYRTEFDVDFGNKNLSGKLFDKNGVNPVFTVDAKINGNGFTGKAKTSDAGFALDSGSSRYDNVKFSDVAVNGGFYGPTAAELGGQFFHKSDNGSVGAVFGA

SEQ ID NO: 108 - protein, 590 aa, Haemophilus parasuis
MHFKLNPYALAFTSLFLVACSGGKGSFDLEDVQPNQTAKVEKATTSYQDEETKKKTKEELDKLMEPALGYETQILRRNRAPKTETGEPRNERAVGLSEDQITKLYQENIEIIPHLDELNRRTTSYEVYHSHDGKGLDKKRDLKYVRSGYVYDGAFREVQRNEHGFHVFKQGIDGYIYYLGVIPSKELPKGKIVTYKGSWDFVSNINLDREIDGFDTSGDGKNVSATSITETVNREHKIGDKVGENEVKGVAHSSEFAVDFDNKKLTGSLYRNGYINRNKAQEVTKRYSIEADIAGNRFRGKAKAEKADDPIFTNSDYLEGGIYGPKAEEMAGKFFTNNKSLFAVFAAKSENGETTTERIIDATKIDLTQFNAKELNNFGDASVLIIDGQKMDLAGVDFKNSKTVEINGKTMVAVACCSNLEYMKFGQLWQKEGEQQVKDNSLFLQGERTATDKMPAGGNYKYVGTWDALVSKGTNWIAEADNNRESGYRTEFDVNFSDKKVNGKLFDKGGVNPVFTVDATINGNGFIGSAKTSDSGFALDSGSSQHGNAVFSNVDVKGGFYGPTAGELGGQFHHKSDNGSVGAVFGAKRQ

SEQ ID NO: 109 - protein, 590 aa, Haemophilus parasuis
MHFKLNPYALAFTSLFLVACSGGKGSFDLEDVQPNQTAKVEKATTSYQDEETKKKTKEELDKLMEPALGYETQILRRNRAPKTETGEPRNERAVGLSEDQITKLYQENIEIIPHLDELNRRTTSDEVYHSHDGKRLDKKRDLKYVRSGYVYDGSFREIQRNDTGFYVFKQGIDGYVYYLGVIPSKELPKGKVVSYKGTWDFVSNINLDREIDGFDTAGDGKNVSATSITETVNREHKIGDKVGENEVKGVAHSSEFAVDFDNKKLTGSLYRNGYINRNKAQEVTKRYSIEADIAGNRFRGKAKAEKADDPIFTNSDYLEGGFYGPKAEEMAGKFFTNNKSLFAVFAAKSENGETTTERIIDATKIDLTQFNAKELNNFGDASVLIIDGQKMDLAGVDFKNSKTVEINGKTMVAVACCSNLEYMKFGQLWQKEGEQQVKDNSLFLQGERTATDKMPAGGNYKYVGTWDALVSKGTNWIAEADNNRESGYRTEFDVNFSDKKVNGKLFDKGGVNPVFTVDATINGNGFIGSAKTSDSGFALDAGSSQHGNAVFSNVDVKGGFYGPTAGELGGQFHHKSDNGSVGAVFGAKRQ

SEQ ID NO: 110 - protein, 540 aa, Haemophilus parasuis
MHFKSDLYIVALTSTFLVACSGGKGSFDLDDVQPNKAVEPEKTKVNYTDEETQKRKKEELDKLMEPALGYVTKIPVNIPSVRKTEISEIDTVTDESLSLVPNEDKLRTIANENYGSVVTKSGSNTMNFVRSGYTIDVDHYGLRDKGYVYYKGVHPSKELPKGNIIVYQGEWDFTSNADLDAKRPNYNPEFNGYGAGQRVGVTSADAKERTYISKFNIDFSNKKLNGQLLTKTKENQEKLRYTVEANISGNRFRGKATATDKTDPILGKDSEHLEGGLYGPKSEELAGKFVAHDKSLFAVFSGKRGNDVLETVKIIDASKIDLTTFESSELNNFGNANVLIIDGQKIDLAGADFKNRKTVDINGKTMVAIACCSNLEYMKFGQLWQKEGEQTKDNSLFLQGERTATDKIPVGGNYKYVGTWDALVSKGTNWVAEADNNRESGYRSEFDVNFGDKKVSGKLFDKGGIVPVFMINADIKGNGFTGTANTTDTGFALDSGSSQHGNAVFSDIKVNGGFYGPTAGELGGQFHHKSDNGSVGAVFG

SEQ ID NO: 111 - protein, 590 aa, Haemophilus parasuis
MHFKLNPYALAFTSLFLVACSGGKGSFDLEDVQPNQTAKVEKATTSYQDEETKKKTKEELDKLMEPALGYETQILRRNRAPKTETGEPRNERAVGLSEDQITKLYQENIEIIPHLDELNRRTTSDEVYHSHDGKRLDKKRDLKYVRSGYVYDGSFREIQRNDTGFYVFKQGIDGYVYYLGVTPSKELPKGKVVSYKGTWDFVSNINLDREIDGFDTSGDGKNVSATSITETVNREHKIGDKVGENEVKGVAHSSEFAVDFDNKKLTGSLYRNGYINRNKAQEVTKRYSIEADIAGNRFRGKAKAEKADDPIFTNSDYLEGGFYGPKAEEMAGKFFTNNKSLFAVFAAKSENGETTTERIIDATKIDLTQFNAKELNNFGDASVLIIDGQKMDLAGADFKNRKTVDINGKTMVAIACCSNLEYMKFGQLWQKEGEQQVKDNSLFLQGERTATDKMPAGGNYKYVGTWDALVSKGTNWIAEADNNRESGYRTEFDVNFSDKKVNGKLFDKGGVNPVFTVDATINGNGFIGSAKTSDSGFALDAGSSQHGNAVFSNVDVKGGFYGPTAGELGGQFHHKSDNGSVGAVFGAKRQ

SEQ ID NO: 112 - protein, 540 aa, Actinobacillus pleuropneumoniae
MHFKLNPYALAFTSLFLVACSGGKGSFDLEDVRPNKTTGVSKEEYKDVETAKKEKEQLGELMEPALGYVVKVPVSSFENKKVDISDIEVITNGNLDDVPYKANSSKYNYPDIKTKDSSLQYVRSGYVIDGEHSGSNEKGYVYYKGNSPAKELPVNQLLTYTGSWDFTSNANLNNEEGRPNYLNDDYYTKFIGKRVGLVSGDAKPAKHKYTSQFEVDFATKKMTGKLSDKEKTIYTVNADIRGNRFTGAATASDKNKGKGESYNFFSADSQSLEGGFYGPKAEEMAGKFVANDKSLFAVFSAKHNGSNVNTVRIIDASKIDLTNFSISELNNFGDASVLIIDGKKIKLAGSGFTNKHTIEINGKTMVAVACCSNLEYMKFGQLWQQAEGGKPENNSLFLQGERTATDKMPKGGNYKYIGTWDAQVSKENNWVATADDDRKAGYRTEFDVDFGNKNLSGKLFDKNGVNPVFTVDAKIDGNGFTGKAKTSDDGFALDSGSSRYENVKFNDVAVSGGFYGPTAAELGGQFHHKSENGSVGAVFG

SEQ ID NO: 113 - protein, 590 aa, Actinobacillus pleuropneumoniae
MHFKLNPYALAFTSLFLVACSGGKGSFDLEDVRPNQTAKAEKATTSYQDEETKKKTKEELDKLMEPALGYETQILRRNKAPKTETGEKRNERVVELSEDKITKLYQESVEIIPHLDELNGKTTSNDVYHSHDSKRLDKNRDLKYVRSGYVYDGSFNEIRRNDSGFHVFKQGIDGYVYYLGVTPSKELPKGKVISYKGTWDFVSNINLDREIDGFDTSGDGKNVSATSITETVNRDHKVGEKLGDNEVKGVAHSSEFAVDFDNKKLTGSLYRNGYINRNKAQEVTKRYSIEADIAGNRFRGKAKAEKAGDPIFTDSNYLEGGFYGPKAEEMAGKFFTNNKSLFAVFAAKSENGETTTERIIDATKIDLTQFNAKELNNFGDASVLIIDGQKIDLAGVNFKNSKTVEINGKTMVAVACCSNLEYMKFGQLWQKEGKQQVKDNSLFLQGERTATDKMPAGGNYKYVGTWDALVSKGTNWIAEADNNRESGYRTEFDVNFSDKKVNGKLFDKGGVNPVFTVDATINGNGFIGSAKTSDSGFALDAGSSQHGNAVFSDIKVNGGFYGPTAGELGGQFHHKSDNGSVGAVFGAKRQ

SEQ ID NO: 114 - protein, 540 aa, Actinobacillus pleuropneumoniae; identical to SEQ ID NO: 2

SEQ ID NO: 115 - protein, 545 aa, Haemophilus parasuis
MHFKLNPYALAFTSLFLVACSGGKGSFDLEDVQPNKTTGVSKEEYQDVETDKKVKEQLGELMEPALGYVVKVPVSQSGARRTEISNPEAITDEDLKKIPNHETIKSVAEQNYGWVVDKTADKTMKYVRSGYAIDVDHYGTRDKGYVFYKGINPSKELPQGLVLTYQGEWDFTSDANLDAKRPNSNPEFNGYGPGQRIATTSANAKGRTYTSEFEVDFSAKKLKGKLNSKTANTESLERYSIEAEPKGNRFRGKAIAKDTSDAILGKSSDYLEGGFYGPKAEELAGKFITNDKSLFAVFSAKHNGSNVDTVRIIDASKIDLTHFNSSELTNFGDASVLIIDGKKMDLAGTDFKNSKTIEINGKTMVAVACCSNLEYMKFGQLWQKEGETAKDNSLFLQGERTTTDKMPKGGNYKYIGTWDAQVSKENNWVATADDDRKAGYRTEFDVDFGNKNLSGKLFDKNGVNPVFTVDAKINGNGFTGKAKTSDAGFALDSDSSRYDNVKFSDVAVNGGFYGPTAAELGGQFFHKSDNGSVGAIFGAKRQVKK

SEQ ID NO: 116 - DNA, 1740 bp, Neisseria meningitidis
tgtctgggtggcggcggcagtttcgatttggacagcgtggaaaccgtgcaagatatgcactccaaacctaagtatgaggatgaaaaaagccagcctgaaagccaacaggatgtatcggaaaacagcggcgcggcttatggctttgcagtaaaactacctcgccggaatgcacattttaatcctaaatataaggaaaagcacaaaccattgggttcaatggattggaaaaaactgcaaagaggagaaccaaatagttttagtgagagggatgaattggaaaaaaaacggggtagttctgaacttattgaatcaaaatgggaagatgggcaaagtcgtgtagttggttatacaaatttcacttatgtccgttcgggatatgtttaccttaataaaaataatattgatattaagaataatatagttctttttggacctgacggatatctttactataaagggaaagaaccttccaaggagctgccatcggaaaagataacttataaaggtacttgggattatgttactgatgctatggaaaaacaaaggtttgaaggattgggtagtgcagcaggaggagataaatcgggggcgttgtctgcattagaagaaggggtattgcgtaatcaggcagaggcatcatccggtcataccgattttggtatgactagtgagtttgaggttgatttttctgataaaacaataaagggcacactttatcgtaacaaccgtattactcaaaataatagtgaaaacaaacaaataaaaactacgcgttacaccattcaagcaactcttcacggcaaccgtttcaaaggtaaggcgttggcggcagataaaggtgcaacaaatggaagtcatccctttatttccgactccgacagtttggaaggcggattttacgggccgaaaggcgaggaacttgccggtaaattcttgagcaacgacaacaaagttgcagcggtgtttggtgcgaagcagaaagataagaaggatggggaaaacgcggcagggcctgcaacggaaaccgtgatagatgcataccgtattaccggcgaggagtttaagaaagagcaaatagacagttttggagatgtgaaaaagctgctggttgacggagtggagctttcactgctgccgtctgagggcaataaggcggcatttcagcacgagattgagcaaaacggcgtgaaggcaacggtgtgttgttccaacttggattacatgagttttgggaagctgtcaaaagaaaataaagacgatatgttcctgcaaggtgtccgcactccagtatccgatgtggcggcaaggacggaggcaaacgccaaatatcgcggtacttggtacggatatattgccaacggcacaagctggagcggcgaagcctccaatcaggaaggtggtaatagggcagagtttgacgtggatttttccactaaaaaaatcagtggcacactgacggcaaaagaccgtacgtctcctgcgtttactattactgccatgattaaggacaacggtttttcaggtgtggcgaaaaccggtgaaaacggctttgcgctggatccgcaaaataccggaaattcccactatacgcatattgaagccactgtatccggcggtttctacggcaaaaacgccatcgagatgggcggatcgttctcatttccgggaaatgcaccagagggaaaacaagaaaaagcatcggtggtattcggtgcgaaacgccaacagcttgtgcaataa

SEQ ID NO: 117 - protein, 579 aa, Neisseria meningitidis
CLGGGGSFDLDSVETVQDMHSKPKYEDEKSQPESQQDVSENSGAAYGFAVKLPRRNAHFNPKYKEKHKPLGSMDWKKLQRGEPNSFSERDELEKKRGSSELIESKWEDGQSRVVGYTNFTYVRSGYVYLNKNNIDIKNNIVLFGPDGYLYYKGKEPSKELPSEKITYKGTWDYVTDAMEKQRFEGLGSAAGGDKSGALSALEEGVLRNQAEASSGHTDFGMTSEFEVDFSDKTIKGTLYRNNRITQNNSENKQIKTTRYTIQATLHGNRFKGKALAADKGATNGSHPFISDSDSLEGGFYGPKGEELAGKFLSNDNKVAAVFGAKQKDKKDGENAAGPATETVIDAYRITGEEFKKEQIDSFGDVKKLLVDGVELSLLPSEGNKAAFQHEIEQNGVKATVCCSNLDYMSFGKLSKENKDDMFLQGVRTPVSDVAARTEANAKYRGTWYGYIANGTSWSGEASNQEGGNRAEFDVDFSTKKISGTLTAKDRTSPAFTITAMIKDNGFSGVAKTGENGFALDPQNTGNSHYTHIEATVSGGFYGKNAIEMGGSFSFPGNAPEGKQEKASVVFGAKRQQLVQ

SEQ ID NO: 118 - DNA, 762 bp, Neisseria meningitidis
cagaaagataagaaggatggggaaaacgcggcagggcctgcaacggaaaccgtgatagatgcataccgtattaccggcgaggagtttaagaaagagcaaatagacagttttggagatgtgaaaaagctgctggttgacggagtggagctttcactgctgccgtctgagggcaataaggcggcatttcagcacgagattgagcaaaacggcgtgaaggcaacggtgtgttgttccaacttggattacatgagttttgggaagctgtcaaaagaaaataaagacgatatgttcctgcaaggtgtccgcactccagtatccgatgtggcggcaaggacggaggcaaacgccaaatatcgcggtacttggtacggatatattgccaacggcacaagctggagcggcgaagcctccaatcaggaaggtggtaatagggcagagtttgacgtggatttttccactaaaaaaatcagtggcacactgacggcaaaagaccgtacgtctcctgcgtttactattactgccatgattaaggacaacggtttttcaggtgtggcgaaaaccggtgaaaacggctttgcgctggatccgcaaaataccggaaattcccactatacgcatattgaagccactgtatccggcggtttctacggcaaaaacgccatcgagatgggcggatcgttctcatttccgggaaatgcaccagagggaaaacaagaaaaagcatcggtggtattcggtgcgaaacgccaacagcttgtgcaa

SEQ ID NO: 119 - protein, 254 aa, Neisseria meningitidis
QKDKKDGENAAGPATETVIDAYRITGEEFKKEQIDSFGDVKKLLVDGVELSLLPSEGNKAAFQHEIEQNGVKATVCCSNLDYMSFGKLSKENKDDMFLQGVRTPVSDVAARTEANAKYRGTWYGYIANGTSWSGEASNQEGGNRAEFDVDFSTKKISGTLTAKDRTSPAFTITAMIKDNGFSGVAKTGENGFALDPQNTGNSHYTHIEATVSGGFYGKNAIEMGGSFSFPGNAPEGKQEKASVVFGAKRQQLVQ

SEQ ID NO: 120 - DNA, 970 bp, Neisseria meningitidis
tgtctgggtggcggcggcagtttcgatttggacagcgtggaaaccgtgcaagatatgcactccaaacctaagtatgaggatgaaaaaagccagcctgaaagccaacaggatgtatcggaaaacagcggcgcggcttatggctttgcagtaaaactacctcgccggaatgcacattttaatcctaaatataaggaaaagcacaaaccattgggttcaatggattggaaaaaactgcaaagaggagaaccaaatagttttagtgagagggatgaattggaaaaaaaacggggtagttctgaacttattgaatcaaaatgggaagatgggcaaagtcgtgtagttggttatacaaatttcacttatgtccgttcgggatatgtttaccttaataaaaataatattgatattaagaataatatagttctttttggacctgacggatatctttactataaagggaaagaaccttccaaggagctgccatcggaaaagataacttataaaggtacttgggattatgttactgatgctatggaaaaacaaaggtttgaaggattgggtagtgcagcaggaggagataaatcgggggcgttgtctgcattagaagaaggggtattgcgtaatcaggcagaggcatcatccggtcataccgattttggtatgactagtgagtttgaggttgatttttctgataaaacaataaagggcacactttatcgtaacaaccgtattactcaaaataatagtgaaaacaaacaaataaaaactacgcgttacaccattcaagcaactcttcacggcaaccgtttcaaaggtaaggcgttggcggcagataaaggtgcaacaaatggaagtcatccctttatttccgactccgacagtttggaaggcggattttacgggccgaaaggcgaggaacttgccggtaaattcttgagcaacgacaacaaagttgcagcggtgtttggtg

SEQ ID NO: 121 - protein, 320 aa, Neisseria meningitidis
CLGGGGSFDLDSVETVQDMHSKPKYEDEKSQPESQQDVSENSGAAYGFAVKLPRRNAHFNPKYKEKHKPLGSMDWKKLQRGEPNSFSERDELEKKRGSSELIESKWEDGQSRVVGYTNFTYVRSGYVYLNKNNIDIKNNIVLFGPDGYLYYKGKEPSKELPSEKITYKGTWDYVTDAMEKQRFEGLGSAAGGDKSGALSALEEGVLRNQAEASSGHTDFGMTSEFEVDFSDKTIKGTLYRNNRITQNNSENKQIKTTRYTIQATLHGNRFKGKALAADKGATNGSHPFISDSDSLEGGFYGPKGEELAGKFLSNDNKVAA

SEQ ID NO: 122 - DNA, 2060 bp, Neisseria meningitidis
tgtctgggcggcggcggcagtttcgatcttgattctgtcgataccgaagccccgcgtcccgcgccaaagtatcaagatgtttcttccgaaaaaccgcaagcccaaaaagaccaaggcggatacggttttgcgatgaggttgaaacggaggaattggtatccgggggcagaagaaagcgaggttaaactgaacgagagtgattgggaggcgacgggattgccgacaaaacccaaggaacttcctaaacggcaaaaatcggttattgaaaaagtagaaacagacggcgacagcgatatttattcttccccctatctcacaccatcaaaccatcaaaacggcagcgctggcaacggtgtaaatcaacctaaaaatcaggcaacaggtcacgaaaatttccaatatgtttattccggttggttttataaacatgcagcgagtgaaaaagatttcagtaacaaaaaaattaagtcaggcgacgatggttatatcttctatcacggtgaaaaaccttcccgacaacttcctgcttctggaaaagttatctacaaaggtgtgtggcattttgtaaccgatacaaaaaagggtcaagattttcgtgaaattatccagccttcaaaaaaacaaggcgacaggtatagcggattttctggtgatggcagcgaagaatattccaacaaaaacgaatccacgctgaaagatgatcacgagggttatggttttacctcgaatttagaagtggatttcggcaataagaaattgacgggtaaattaatacgcaataatgcgagcctaaataataatactaataatgacaaacataccacccaatactacagccttgatgcacaaataacaggcaaccgcttcaacggcacggcaacggcaactgacaaaaaggagaatgaaaccaaactacatccctttgtttccgactcgtcttctttgagcggcggctttttcggcccgcagggtgaggaattgggtttccgctttttgagcgacgatcaaaaagttgccgttgtcggcagcgcgaaaaccaaagacaaactggaaaatggcgcggcggcttcaggcagcacaggtgcggcagcatcgggcggtgcggcaggcacgtcgtctgaaaacagtaagctgaccacggttttggatgcggttgaattgacactaaacgacaagaaaatcaaaaatctcgacaacttcagcaatgccgcccaactggttgtcgacggcattatgattccgctcctgcccaaggattccgaaagcgggaacactcaggcagataaaggtaaaaacggcggaacagaatttacccgcaaatttgaacacacgccggaaagtgataaaaaagacgcccaagcaggtacgcagacgaatggggcgcaaaccgcttcaaatacggcaggtgataccaatggcaaaacaaaaacctatgaagtcgaagtctgctgttccaacctcaattatctgaaatacggaatgttgacgcgcaaaaacagcaagtccgcgatgcaggcaggaggaaacagtagtcaagctgatgctaaaacggaacaagttgaacaaagtatgttcctccaaggcgagcgtaccgatgaaaaagagattccaaccgaccaaaacgtcgtttatcgggggtcttggtacgggcatattgccaacggcacaagctggagcggcaatgcttctgataaagagggcggcaacagggcggaatttactgtgaattttgccgataaaaaaattaccggcaagttaaccgctgaaaacaggcaggcgcaaacctttaccattgagggaatgattcagggcaacggctttgaaggtacggcgaaaactgctgagtcaggttttgatctcgatcaaaaaaataccacccgcacgcctaaggcatatatcacagatgccaaggtaaagggcggtttttacgggcctaaagccgaagagttgggcggatggtttgcctatccgggcgataaacaaacggaaaaggcaacagctacatccagcgatggaaattcagcaagcagcgcgaccgtggtattcggtgcgaaacgcca

SEQ ID NO: 123 - protein, 680 aa, Neisseria meningitidis
CLGGGGSFDLDSVDTEAPRPAPKYQDVSSEKPQAQKDQGGYGFAMRLKRRNWYPGAEESEVKLNESDWEATGLPTKPKELPKRQKSVIEKVETDGDSDIYSSPYLTPSNHQNGSAGNGVNQPKNQATGHENFQYVYSGWFYKHAASEKDFSNKKIKSGDDGYIFYHGEKPSRQLPASGKVIYKGVWHFVTDTKKGQDFREIIQPSKKQGDRYSGFSGDGSEEYSNKNESTLKDDHEGYGFTSNLEVDFGNKKLTGKLIRNNASLNNNTNNDKHTTQYYSLDAQITGNRFNGTATATDKKENETKLHPFVSDSSSLSGGFFGPQGEELGFRFLSDDQKVAVVGSAKTKDKLENGAAASGSTGAAASGGAAGTSSENSKLTTVLDAVELTLNDKKIKNLDNFSNAAQLVVDGIMIPLLPKDSESGNTQADKGKNGGTEFTRKFEHTPESDKKDAQAGTQTNGAQTASNTAGDTNGKTKTYEVEVCCSNLNYLKYGMLTRKNSKSAMQAGGNSSQADAKTEQVEQSMFLQGERTDEKEIPTDQNVVYRGSWYGHIANGTSWSGNASDKEGGNRAEFTVNFADKKITGKLTAENRQAQTFTIEGMIQGNGFEGTAKTAESGFDLDQKNTTRTPKAYITDAKVKGGFYGPKAEELGGWFAYPGDKQTEKATATSSDGNSASSATV

SEQ ID NO: 124 - DNA, 1030 bp, Neisseria meningitidis
accaaagacaaactggaaaatggcgcggcggcttcaggcagcacaggtgcggcagcatcgggcggtgcggcaggcacgtcgtctgaaaacagtaagctgaccacggttttggatgcggttgaattgacactaaacgacaagaaaatcaaaaatctcgacaacttcagcaatgccgcccaactggttgtcgacggcattatgattccgctcctgcccaaggattccgaaagcgggaacactcaggcagataaaggtaaaaacggcggaacagaatttacccgcaaatttgaacacacgccggaaagtgataaaaaagacgcccaagcaggtacgcagacgaatggggcgcaaaccgcttcaaatacggcaggtgataccaatggcaaaacaaaaacctatgaagtcgaagtctgctgttccaacctcaattatctgaaatacggaatgttgacgcgcaaaaacagcaagtccgcgatgcaggcaggaggaaacagtagtcaagctgatgctaaaacggaacaagttgaacaaagtatgttcctccaaggcgagcgtaccgatgaaaaagagattccaaccgaccaaaacgtcgtttatcgggggtcttggtacgggcatattgccaacggcacaagctggagcggcaatgcttctgataaagagggcggcaacagggcggaatttactgtgaattttgccgataaaaaaattaccggcaagttaaccgctgaaaacaggcaggcgcaaacctttaccattgagggaatgattcagggcaacggctttgaaggtacggcgaaaactgctgagtcaggttttgatctcgatcaaaaaaataccacccgcacgcctaaggcatatatcacagatgccaaggtaaagggcggtttttacgggcctaaagccgaagagttgggcggatggtttgcctatccgggcgataaacaaacggaaaaggcaacagctacatccagcgatggaaattcagcaagcagcgcgaccgtggtattcggtgcgaaacgccaacagc

SEQ ID NO: 125 - protein, 343 aa, Neisseria meningitidis
TKDKLENGAAASGSTGAAASGGAAGTSSENSKLTTVLDAVELTLNDKKIKNLDNFSNAAQLVVDGIMIPLLPKDSESGNTQADKGKNGGTEFTRKFEHTPESDKKDAQAGTQTNGAQTASNTAGDTNGKTKTYEVEVCCSNLNYLKYGMLTRKNSKSAMQAGGNSSQADAKTEQVEQSMFLQGERTDEKEIPTDQNVVYRGSWYGHIANGTSWSGNASDKEGGNRAEFTVNFADKKITGKLTAENRQAQTFTIEGMIQGNGFEGTAKTAESGFDLDQKNTTRTPKAYITDAKVKGGFYGPKAEELGGWFAYPGDKQTEKATATSSDGNSASSATVVFGAKRQQ

SEQ ID NO: 126 - DNA, 1030 bp, Neisseria meningitidis
tgtctgggcggcggcggcagtttcgatcttgattctgtcgataccgaagccccgcgtcccgcgccaaagtatcaagatgtttcttccgaaaaaccgcaagcccaaaaagaccaaggcggatacggttttgcgatgaggttgaaacggaggaattggtatccgggggcagaagaaagcgaggttaaactgaacgagagtgattgggaggcgacgggattgccgacaaaacccaaggaacttcctaaacggcaaaaatcggttattgaaaaagtagaaacagacggcgacagcgatatttattcttccccctatctcacaccatcaaaccatcaaaacggcagcgctggcaacggtgtaaatcaacctaaaaatcaggcaacaggtcacgaaaatttccaatatgtttattccggttggttttataaacatgcagcgagtgaaaaagatttcagtaacaaaaaaattaagtcaggcgacgatggttatatcttctatcacggtgaaaaaccttcccgacaacttcctgcttctggaaaagttatctacaaaggtgtgtggcattttgtaaccgatacaaaaaagggtcaagattttcgtgaaattatccagccttcaaaaaaacaaggcgacaggtatagcggattttctggtgatggcagcgaagaatattccaacaaaaacgaatccacgctgaaagatgatcacgagggttatggttttacctcgaatttagaagtggatttcggcaataagaaattgacgggtaaattaatacgcaataatgcgagcctaaataataatactaataatgacaaacataccacccaatactacagccttgatgcacaaataacaggcaaccgcttcaacggcacggcaacggcaactgacaaaaaggagaatgaaaccaaactacatccctttgtttccgactcgtcttctttgagcggcggctttttcggcccgcagggtgaggaattgggtttccgctttttgagcgacgatcaaaaagttgccgttgtcggcagcg

SEQ ID NO: 127 - protein, 340 aa, Neisseria meningitidis
CLGGGGSFDLDSVDTEAPRPAPKYQDVSSEKPQAQKDQGGYGFAMRLKRRNWYPGAEESEVKLNESDWEATGLPTKPKELPKRQKSVIEKVETDGDSDIYSSPYLTPSNHQNGSAGNGVNQPKNQATGHENFQYVYSGWFYKHAASEKDFSNKKIKSGDDGYIFYHGEKPSRQLPASGKVIYKGVWHFVTDTKKGQDFREIIQPSKKQGDRYSGFSGDGSEEYSNKNESTLKDDHEGYGFTSNLEVDFGNKKLTGKLIRNNASLNNNTNNDKHTTQYYSLDAQITGNRFNGTATATDKKENETKLHPFVSDSSSLSGGFFGPQGEELGFRFLSDDQKVAV

SEQ ID NO: 128 - DNA, 735 bp, Neisseria meningitidis
ggatcctcgtctgaaaacagtaagctgaccacggttttggatgcggttgaattgacactaaacgacaagaaaatcaaaaatctcgacaacttcagcaatgccgcccaactggttgtcgacggcattatgattgatctggccggaacagaatttacccgcaaatttgaacacacgattaacggcaaaacctatgaagtcgaagtctgctgttccaacctcaattatctgaaatacggaatgttgacgcgcaaaggcaaacaggttgaacaaagtatgttcctccaaggcgagcgtaccgatgaaaaagagattccaaccgaccaaaacgtcgtttatcgggggtcttggtacgggcatattgccaacggcacaagctggagcggcaatgcttctgataaagagggcggcaacagggcggaatttactgtgaattttgccgataaaaaaattaccggcaagttaaccgctgaaaacaggcaggcgcaaacctttaccattgagggaatgattcagggcaacggctttgaaggtacggcgaaaactgctgagtcaggttttgatctcgatcaaaaaaataccacccgcacgcctaaggcatatatcacagatgccaaggtaaagggcggtttttacgggcctaaagccgaagagttgggcggatggtttgcctatcataaaagcgataacggcagcgcgaccgtggtattcggtgcgaaacgccaacagcctgtgcaa

SEQ ID NO: 129 - protein, 245 aa, Neisseria meningitidis
GSSSENSKLTTVLDAVELTLNDKKIKNLDNFSNAAQLVVDGIMIDLAGTEFTRKFEHTINGKTYEVEVCCSNLNYLKYGMLTRKGKQVEQSMFLQGERTDEKEIPTDQNVVYRGSWYGHIANGTSWSGNASDKEGGNRAEFTVNFADKKITGKLTAENRQAQTFTIEGMIQGNGFEGTAKTAESGFDLDQKNTTRTPKAYITDAKVKGGFYGPKAEELGGWFAYHKSDNGSATVVFGAKRQQPVQ

SEQ ID NO: 130 - DNA, 945 bp, Neisseria meningitidis
ggatcctcgtctgaaaacagtaagctgaccacggttttggatgcggttgaattgacactaaacgacaagaaaatcaaaaatctcgacaacttcagcaatgccgcccaactggttgtcgacggcattatgattccactcctcccagccacaaaagccgtctttgatgagaaccgcaaatacggcccggaatttacccgcaaatttgaacacacggccaaggaaatcacagagttgttgggcagccgggctttgctcaacggcaacagccgcaatacaaaagccaccgcgcgccgtacccgcacctatgaagtcgaagtctgctgttccaacctcaattatctgaaatacggaatgttgacgcgcaaagttacttgggaaaatgtgcggcaaactgccggcggcgcagtcaaccaacacaaaaatgtcggcgtttacaaccgatatgccgttgaacaaagtatgttcctccaaggcgagcgtaccgatgaaaaagagattccaaccgaccaaaacgtcgtttatcgggggtcttggtacgggcatattgccaacggcacaagctggagcggcaatgcttctgataaagagggcggcaacagggcggaatttactgtgaattttgccgataaaaaaattaccggcaagttaaccgctgaaaacaggcaggcgcaaacctttaccattgagggaatgattcagggcaacggctttgaaggtacggcgaaaactgctgagtcaggttttgatctcgatcaaaaaaataccacccgcacgcctaaggcatatatcacagatgccaaggtaaagggcggtttttacgggcctaaagccgaagagttgggcggatggtttgcctataccgcgcaggcggcattgggcgggacgaggacggcgggcagcagcgcgaccgtggtattcggtgcgaaacgccaacagcctgtgcaa

SEQ ID NO: 131 - protein, 315 aa, Neisseria meningitidis
GSSSENSKLTTVLDAVELTLNDKKIKNLDNFSNAAQLVVDGIMIPLLPATKAVFDENRKYGPEFTRKFEHTAKEITELLGSRALLNGNSRNTKATARRTRTYEVEVCCSNLNYLKYGMLTRKVTWENVRQTAGGAVNQHKNVGVYNRYAVEQSMFLQGERTDEKEIPTDQNVVYRGSWYGHIANGTSWSGNASDKEGGNRAEFTVNFADKKITGKLTAENRQAQTFTIEGMIQGNGFEGTAKTAESGFDLDQKNTTRTPKAYITDAKVKGGFYGPKAEELGGWFAYTAQAALGGTRTAGSSATVVFGAKRQQPVQ

SEQ ID NO: 132 - protein, 670 aa, Neisseria meningitidis
CLGGGGSFDLDSVDTEAPRPAPKYQDVSSEKPQAQKDQGGYGFAMRFKRRNWHPRVNPKEDKIELSENDWEQTDNGNIKTPSKQKNIINALLGSEGALLQDSSQEGQSISKVTDHHNFQYVWSGFFYKHIQTKFETTGGKMTARSGPDGYIFYKGKDPSRKLPVSGEVMYKGTWDFLTDVKANQKFTDLGNASTKPGDRYSAFSGELDYIVKQENDKKDGHVGLGLTTEITVDFEKKTLSGKLIKNNSVITTNNDKHTTQYYSLEATLKGNRFNGKATATDKPKENEIKQHPFVSDSSSLSGGFFGPQGEELGFRFLSDDKKVAVVGSAKTKDKAESGNGNGNGTSGGASVSASNGAAGTSSENSKLTTVLDAVELKSGDKEVKKLDNFSNAAQLVVDGIMIPLLPEASESGSNQANQGTNGGTAFTRKFNHTPKSDEKDTQAGTAENGNPAASNTAGDANGKTKTYEVEVCCSNLNYLKYGMLTRKNSKSAMQAGESSSQADAKTEQVEQSMFLQGERTDEKEIPNDQNVVYRGSWYGHIANGTSWSGNASDKEGGNRADFTVNFGTKKINGTLTADNRQAATFTIVGDIEGNGFSGTAKTADSGFDLDQSNNTRTPKAYITNAKVQGGFYGPKAEELGGWFAYSDDKQTKNATDASGNGNSASSATVV

SEQ ID NO: 133 - protein, 660 aa, Neisseria meningitidis
CLGGGGSFDLDSVDTEAPRPAPKYQDVSSEKPQAQKDQGGYGFAMRFKRRNWYQRANPKEDEIKLSEDDWEQTDDGDIKNPSKQKNIINALPGNNEGALLQDSSQENQGISKVKDYHNFQYVWSGFFYKQIKNTIEKNGSSITAARNGPDGYIFYKGKDPSRKLPVSGEVMYKGTWDFLTDVKANQKFTDLGNASTKPGDRYSAFSGELDYIVKQENDKKDGHVGLGLTTEITVDFEKKTLSGKLIKNNSVITTNNDKHTTQYYSLEATLKGNRFNGKATATDKPKENETKQHPFVSDSSSLSGGFFGPQGEELGFRFLSDDKKVAVVGSAKTKDKPGNGAAAPGGTDAAASNGAAGTSSENSKLTTVLDAVELKSGGKEVKNLDNFSNAAQLVVDGIMIPLLPKDSESGNTQADKGKNGGTEFTRKFEHTPESDKKDAQAGTAENGNPAASNTAGDTNGKTKTYAVEVCCSNLNYLKYGLLTRKTAGNTGEGGNGAAQTDAQSMFLQGERTDEKEIPNDQNIVYRGSWYGHIANGTSWSGNASDKEGGNRAEFTVNFADKKLNGTLTAGERTSPTFTITATIQGNGFEGTAKTGDDGFALDTKNTVDTHKAHITDANVQGGFYGPKAEELGGWFAYPGDRQAQPSASGSGTSAANSATV

SEQ ID NO: 134 - protein, 640 aa, Neisseria meningitidis
PAPKYQDVSSEKPQAQKDQGGYGFAMRLKRRNWHTQANPKEDEIKLSENDWEATGLPGNPKNLPERQKSVIEKVETDDGSNIYSSPYLTQSNHPNGNTGNGTNLPKNEVTDYKDFKYVYSGWFYKHAKRNFDITNKIVRQGDDGYIFYHGKEPSRQLPVSEKITYKGVWHFVTDTKNGQKFYDIIQPSKKQGDRYSGFSGDDDEQYSNKNDMLKGDHEGYGFTSNLEVDFDDKKLTGKLIRNDKVTNATTGNKHTTQYYSLEAQVTGNRFNGKAIATDKPQENGTKQHPFVSDSSSLSGGFFGPQGEELGFRFLSDDQKVAVVGSAKTKDKPANGNTAAASGGTDAAASGGTAGTPSESTKLTTVLDAVELKSGDKEVKKLDNFSNAAQLVVDGIMIPLLPEASESGNNQANQGTNGGTAFTRKFNHTPKSDEKDTQAGTAENGNPAASNTAGDANGKTKTYEVEVCCSNLNYLKYGLLTRKTAGNTGEGGNGSPTAAQTDAQSMFLQGERTDEKEIPKEQQDIVYRGSWYGHIANGTSWSGNASDKEGGNRAEFTVNFGDKKITGTLTADNRQAATFTIEGDIEGNGFSGTAKTDNLGFDLDQSDNTRTPKAYITDAKVQGGFYGPKAEELGGWFAYPG

SEQ ID NO: 135 - protein, 700 aa, Neisseria meningitidis
CLGGGGSFDLDSVDTEAPRPAPKYQDVSSEKPQAQKDQGGYGFAMRLKRRNWHPQANPKEDEIKLSENDWEATGLPGNPKNLPERQKSVIEKVKTGSDSNIYSSPYLTQSNHQNGSANQPKNEVKDYKEFKYVYSGWFYKHAKLEIIKENNLIKGAKSGDDGYIFYHGEKPSRQLPVSGEVTYKGVWHFVTDTKQGQKFNDILGTSKKQGDRYSGFPGDDGEEYSNKNEATLQGSQEGYGFTSNLKVDFNKKKLTGELIRNNRVTNATANDKYTTQYYSLEAQVTGNRFNGKATATDKPGTGETKQHPFVSDSSSLSGGFFGPKGEELGFRFLSNDQKVAVVGSAKTQDKAANGNTAAASGGTDAAASNGAAGTSSENSKLTTVLDAVELTLNDKKIKNLDNFSNAAQLVVDGIMIPLLPETSESGSNQADKGKKGKNGKNGGTDFTYKTTYTPKNDDKDTKAQTGAAGSSGAQTDLGKADVNGGKAETKTYEVEVCCSNLNYLKYGMLTRKNSKSAMQAGGNSSQADAKTEQVEQSMFLQGERTDEKEIPNDQNVVYRGSWYGHIASSTSWSGNASNATSGNRAEFTVNFDTKKINGTLTAENRQEATFTIDGKIEGNGFSGTAKTADLGFDLDQSNTTGTPKAYITDAKVQGGFYGPKAEELGGWFAYPGDKQTEKATVASGDGNSASSATVVFGAKR

SEQ ID NO: 136 - protein, 680 aa, Neisseria meningitidis
CLGGGGSFDLDSVDTEAPRPAPKYQDVFSEKPQAQKDQGGYGFAMRLKRRNWYPQAKEDEVKLDESDWEATGLPDEPKELPKRQKSVIEKVETDSDNNIYSSPYLKPSNHQNGNTGNGINQPKNQAKDYENFKYVYSGWFYKHAKREFNLKVEPKSAKNGDDGYIFYHGKEPSRQLPASGKITYKGVWHFATDTKKGQKFREIIQPSKSQGDRYSGFSGDDGEEYSNKNKSTLTDGQEGYGFTSNLEVDFHNKKLTGKLIRNNANTDNNQATTTQYYSLEAQVTGNRFNGKATATDKPQQNSETKEHPFVSDSSSLSGGFFGPQGEELGFRFLSDDQKVAVVGSAKTKDKPANGNTAAASGGTDAAASNGAAGTSSENGKLTTVLDAVELKLGDKEVQKLDNFSNAAQLVVDGIMIPLLPEASESGNNQANQGTNGGTAFTRKFDHTPESDKKDAQAGTQTNGAQTASNTAGDTNGKTKTYEVEVCCSNLNYLKYGMLTRKNSKSAMQAGESSSQADAKTEQVEQSMFLQGERTDEKEIPSEQNIVYRGSWYGYIANDKSTSWSGNASNATSGNRAEFTVNFADKKITGTLTADNRQEATFTIDGNIKDNGFEGTAKTAESGFDLDQSNTTRTPKAYITDAKVQGGFYGPKAEELGGWFAYPGDKQTKNATNASGNSSAT

SEQ ID NO: 137 - protein, 680 aa, Neisseria meningitidis
CLGGGGSFDLDSVDTEAPRPAPKYQDVSSEKPQAQKDQGGYGFAMRLKRRNWYPQAKEDEVKLDESDWEATGLPDEPKELPKRQKSVIEKVETDSDNNIYSSPYLKPSNHQNGNTGNGINQPKNQAKDYENFKYVYSGWFYKHAKREFNLKVEPKSAKNGDDGYIFYHGKEPSRQLPASGKITYKGVWHFATDTKKGQKFREIIQPSKSQGDRYSGFSGDDGEEYSNKNKSTLTDGQEGYGFTSNLEVDFHNKKLTGKLIRNNANTDNNQATTTQYYSLEAQVTGNRFNGKATATDKPQNSETKEHPFVSDSSSLSGGFFGPQGEELGFRFLSDDQKVAVVGSAKTKDKPANGNTAAASGGTDAAASNGAAGTSSENGKLTTVLDAVELKLGDKEVQKLDNFSNAAQLVVDGIMIPLLPEASESGNNQANQGTNGGTAFTRKFDHTPESDKKDAQAGTQTNGAQTASNTAGDTNGKTKTYEVEVCCSNLNYLKYGMLTRKNSKSAMQAGESSSQADAKTEQVEQSMFLQGERTDEKEIPSEQNVVYRGSWYGHIANGTSWSGNASDKEGGNRAEFTVDFGAKKINGKLTAENRQAATFTIEGDIEGNGFSGTAKTAESGFDLDQSNTTRTPKAYITDAKVQGGFYGPKAEELGGWFAYPGDKQTKNATNASGNSSATVVF

SEQ ID NO: 138 - protein, 690 aa, Neisseria meningitidis
CLGGGGSFDLDSVDTEAPRPAPKYQDVSSETPKAQKDQGGYGFAMRFKRLNRHPKAMPQENEVKLKNDDWEVTGLPTEPKKLPLKQESVILQVQASNGDNNIYTSPYLTQSSHNSHNGSVNGGANQPKNEATGYKNFEYVYSGWFYKHAANETDFSKNKFKSGDDGYIFYHGKKPSRQLPASGKVTYKGVWHFVTDTKKGQKFHDILEASKGQGDRYSGFSGDEGETISNRTDSELKTDQEGYGFTSNLEVDFDNKKLTGKLIRNDKVTNATTGDKHTTQYYSLEAQVTGNRFSGKAEATDKPEQDGTKQHPFVSDSSSLSGGFFGPQGEELGFRFLSNDQKVAVVGSAKTKDKAESGKTVAASGGTGAAASGGAADMPSENGKLTTVLDAVELTLNDKKIKNLDNFSNAAQLVVDGIMIPLLPKDSESGNNQANQGTNGGTAFTYKTTYTPKSDEKDTQAGTAANGNQAASNTAGDTNGKTKTYEVEVCCSNLNYLKYGMLTRKNSKSAMQAGENGSQADAKTEQVEQSMFLQGERTDEKEIPKEQQDIVYRGSWYGHIAGSTSWSGNASNATSGNRAEFTVNFDTKKINGKLTAENRQAATFTIVGDIKDNGFEGTAKTDNLGFDLDQSNTTGTPKAYITNAKVQGGFYGPKAEELGGWFAYSDDKQTKNATDASGNGNSASSATVVF

SEQ ID NO: 139 - protein, 680 aa, Neisseria meningitidis
CLGGGGSFDLDSVDTEAPRPAPKYQDVSSEKPQAQKDQGGYGFAMRLKRRNRHPQAKEDKVELNPNDWEETGLPSKPQNLPERQQSVIDKVKTDDGSNIYTSPYLTQSNHQNGSTNSGANQPKNEVKDYKNFKYVYSGWFYKHAESEREFSKIKFKSGDDGYIFYHGKDPSRQLPTSEKVIYKGVWHFVTDTEKGQKFNDILETSKGQGDRYSGFSGDDGETTSNRTDSNLNDKHEGYGFTSNLEVDFGSKKLTGKLIRNNRVTNATTNDKYTTQYYSLDAQITGNRFNGKAIATDKPDTGGTKLHPFVSDSSSLSGSFFGPKGEELGFRFLSDDKKVAVVGSAKTKDKNANGNTPAASSGAGAATMPSETRLTTVLDAVELKSGGKEVQKLDNFSNAAQLVVDGIMIPLLPEASESGKNQADKGKNGGTAFTYTITYTPESDKKDTQAGTPTNGAQTASNTAGDTNGKTKTYEVEVCCSNLNYLKYGMLTRKNSKSAMQAGESSSQADAKTEQVEQSMFLQGERTDEKEIPSEQNIVYRGSWYGYIANDKSTSWSGNASNATSGNRAEFTVNFADKKITGTLTADNRQEATFTIDGNIKDNGFEGTAKTAESGFDLDQSNTTRTPKAYITDAKVQGGFYGPKAEELGGWFAYPGDKQTKNATNASGNSSATVVFGAKRQ

SEQ ID NO: 140 - protein, 570 aa, Neisseria meningitidis
CLGGGGSFDLDSVETKQHNPQPEAPKYQDEQTEKPAKPDEASAAENDRPAYGFAVKIPRRNVHFNVKQGHQPLSDADWVKLAAGEPDKFPQKDEISNMTGGTLNESLQPGGDGKSRVEGYTDFKYVRSGYIYRDVNKIDPKNNIALFGPDGYLFYKGSNPSQALPTGKVGYKGTWDYVTDAKMGQKFPQLGNSKAGDRYGALSAQEEDVLRNKSEAPEGHTDFGLTSEFEVDFAAKTMTGALYRNNRITHNETENKDKRIKRYDIKADLHGNRFKGKALAADKDAGNGHPFVSDSDSLEGGFYGPQGDELGGKFLANDKKVLAVFSAKQKDGAEKPLAETFMDAYRIGSDFVKKQIDSFGNVAKLLIDGVELALVPSEGTQTAFQHVFKKDGVKVSSCCSNLDYLHFGVLEHGDSHDMFLQGSRTPVSDMPVTAGEAVYRGTWSGTIVNGTSWSAEPSDKEGGNRAEFKVNFAERTLNGMLTAKNHIAPVFTITAQIQGNGFSGTAKTGESGFALDPKSTIDSVYTRIQADVSGGFYGKNAIEMGGSFSGNTLKGESGKAAVVFGTKRQQ

SEQ ID NO: 141 - protein, 660 aa, Neisseria meningitidis
CLGGGGSFDLDSVDTEAPRPAPKYQDVSSETPQAQKDQGGYGFAMRFKRRNWYPKNEEDHKALSEADWEKLGAGKPDEFPQRNEILNMTDGILSESLQLGEGGKSRVEGYTDFQYVRSGYIYRNGANKIDFQKKIALSGPDGYLFYKGSNPSQALPMGKVGYKGTWDYVTDAKMGQKFSQLAGFPAGDRYGALSAEEADVLRNKSEAQQGQTDFGLTSEFEVDFAAKTMTGALYRNNRITNNETENKAKQIKRYDIQADLHGNRFSGKATATDKPKNDETKEHPFVSDSSSLSGGFFGPKGEELGFRFLSDDQKVAVVGSAKTKDKLENGAAASGSTGAAASGGAADMPSENGKLTTVLDAVELKSGGKEVKNLDNFSNAAQLVVDGIMIPLLPKESESESNQADKGKNGGTAFTRKFEHTPESDKKDTQAGTAENGNPAASNTAGDTNGKTKTYEVEVCCSNLNYLKYGMLTRKNSKSAMQAGENGSQADAKTEQVEQSMFLQGERTDEKEIPKEQQDIVYRGSWYGHIANDTSWSGNASDREGGNRADFTVNFGTKKINGTLTAENRQEATFTIVGDIKDNGFEGTAKTADSGFDLDQSNTTRTPKAYITDAKVKGGFYGPKAEELGGWFAYPGDKQTEKATVTSGDGNSASSATVVF

SEQ ID NO: 142 - protein, 660 aa, Neisseria meningitidis
CLGGGGSFDLDSVDTEAPRPAPKYQDVSSETPQAQKDQGGYGFAMRFKRRNWHPKNKEDHKALSEADWEKLGAGKPDEFPQKNEISAMDKGTLNESITPGDGKSRAEGYTDFQYVRSGYIYRNGVNKIDYQNNIALSGPDGYLFYKGSNPSQALPTGKAIYKGTWDYVTDAKEKQKFPQLGSFQAGDRYGALSAEEEDVLRNKSEAKEGQTDFGLTSEFEVDFAAKTMTGKLYRNNRITNNETENRDKQIKRYDIQANLHGNRFNGKATATDKPKENETKQHPFVSDSSSLSGGFFGPQGEELGFRFLSNDQKVAVVGSAKTQDKAANGNTAAASGDASVSASNGAAGTSSENGKLTTVLDAVELTLNDKKIKNLDNFSNAAQLVVDGIMIPLLPETSESGNNQADKGKNGGTAFTRKFDHTPKSDEKDTQAGTAANGAQTASGTAGDTSGKTKTYQVEVCCSNLNYLKYGMLTRKNSESAMQAGESSSQTPAAQTAQGAQSMFLQGERTDENKIPTDQNVVYRGSWYGHIASSTSWSGNASNATSGNRAEFTVNFDTKKITGKLTAENRQEATFTIDGKIEGNGFEGTAKTAELGFDLDQSNTTGTPKAYITNAKVQGGFYGPKAEELGGWFAYPGDKQTENTTVASGNGNSASSATVV

SEQ ID NO: 143 - protein, 670 aa, Neisseria meningitidis
CLGGGGSFDLDSVDTEAPRPAPKYQDVSSETPQAQKDQGGYGFAMRFKRRNWHPRGNPKEDKIELSENDWEQTDNGDIKNPSKQKKIINDLLGNGGALLQDSSQEGQSISKVTDHHDFQYVWSGFFYKQIQTKFETTDGKMTVRSGPDGYIFYKGKDPSRKLPVSGEVMYKGTWDFLTDVKTSQKFTDLGNTSTRPGDRYSAFSGELDYIVNKDSDKKDEHVGWGLTTEITVDFEKKTLSGKLIKNNRVNNDNDKHTTQYYSLDATLRGNRFNGKATATDKPKNDGETKEHPFVSDSSSLSGGFFGPQGEELGFRFLSKDQKVAVVGSAKTKDKPANGNTAEASGGTGAAASDGAAGTSSKNGKLTTVLDAVELKLGDKEVQKLDNFSNAAQLVVDGIMIPLLPEASESGNTNQGTNGGTAFTRKFEQMPESDEKDTKAQTGTGGTQTASNTAGDTNGKTKTYEVEVCCSNLNYLKYGMLTRKNSKSAMQAGESSSQADAKTEQVGQSMFLQGERTDEKEIPNDQNVVYRGSWYGHIANGTSWSGNASDKEGGNRADFTVNFGTKKINGTLTADNRQAATFTIVGDIEGNGFSGTAKTADSGFDLDQSNNTRTPKAYITNAKVQGGFYGPKAEELGGWFAYSDDKQTKNATDASGNGNSASSATVVFGAK

SEQ ID NO: 144 - protein, 660 aa, Neisseria meningitidis
FDLDSVDTEAPRPAPKYQDVSSEKPQAQKDQGGYGFAMRLKRRNWYRQANPKEDEIKLSENDWEQTDNGDIKNPSKQKNIINALTGNNGGASLQDSSQENQGISKVTGHHNFQYVWSGFFYKQIGSTFERKDSSITAARSGPDGYIFYKGKDPSRKLPVSGEVMYKGTWDFLTDVKTSQKFTDLGNTSTRPGDRYSAFSGGLDYIVNKDSDKKDEHVGWGLTTEITVDFEKKTLSGKLIKNNRVNNDNDKHTTQYYSLDATLRGNRFSGKAEATDKPKNDGETKEHPFVSDSSSLSGGFFGPKGEELGFRFLSDDQKVAVVGSAKTQDKPRNGAVASGGAGAAASNGAAGTSSENSKLTTVLDAVELTLNDKKIKNLDNFSNAAQLVVDGIMIPLLPEASESGKNQANQGTNGGTAFTRKFNHTPKSDEKDTQAGTAENGNPAASNTAGDANGKTKTYEVEVCCSNLNYLKYGMLTRKNSKSAMQAGESSSQADAKTEQVGQSMFLQGERTDEKEIPNDQNVVYRGSWYGHIANGTSWSGNASDKEGGNRADFTVNFGTKKINGTLTADNRQAATFTIVGDIEGNGFSGTAKTADSGFDLDQSNNTRTPKAYITNAKVQGGFYGPKAEELGGWFAYSDDKQTKNATDASGNGNSASSATV

SEQ ID NO: 145 - protein, 690 aa, Neisseria meningitidis
CLGGGGGSFDLDSVDTEAPRPAPKYQDVSSEKPQAQKDQGGYGFAMRLKRRNWYPSAKENEVKLNESDWETTGLPSNPKNLPERQKSVIDQVETDGDSNNSNIYSSPYLTQSNHQNGNTGNGVNQPKNEVTDYKNFKYVYSGWFYKHAKREVNLAVEPKSAKNGDDGYIFYHGKDPSRQLPASGKITYKGVWHFATDTKRGQKFREIIQPSKNQGDRYSGFSGDDDEQYSNKNESMLKDGHEGYGFTSNLEVDFDNKKLTGKLIRNNANQNNNTNNDKHTTQYYSLDATLKGNRFSGKAEATDKPKNDGETKEHPFVSDSSSLSGGFFGPQGEELGFRFLSNDQKVAVVGSAKTKDKPANGNTAEASGGTDAAASGGAAGTSSENSKLTTVLDAVELTHGGTAIKNLDNFSNAAQLVVDGIMIPLLPQNSTGKNNQPDQGKNGGTAFIYKTTYTPKNDDKDTKAQTVTGGTQTASNTAGDANGKTKTYEVEVCCSNLNYLKYGLLTRKTAGNTVGSGNSSPTAAAQTDAQSMFLQGERTDENKIPSEQNVVYRGSWYGHIASSTSWSGNASDKEGGNRAEFTVNFGEKKITGTLTAENRQEATFTIDGKIEGNGFSGTAKTAELGFDLDQKNTTRTPKAYITDAKVKGGFYGPKAEELGGWFAYSDDKQTKNATDASGNGNSASSATVVF

SEQ ID NO: 146 - protein, 690 aa, Neisseria meningitidis
CLGGGGSFDLDSVDTEAPRPAPKYQDVSSEKPQAQKDQGGYGFAMRLKRRNWYPQAKEDEVKLNESDWEATGLPTEPKKLPLKQESVISKVQANNGDNNIYTSPYLTQSNHQNGNTGNGANLPKNEVTNYKDFKYVYSGWFYKHARNEIIRENSSIKGAKNGDDGYIFYHGKEPSRQLPASGTVTYKGMWHFATDVKKSQNFRDIIQPSKKQGDRYSGFSGDDDEQYSNKNESMLKDDQEGYGFTSNLEVDFNNKKLTGKLIRNDKVTNATTSGKHTTQYYSLEAQVTGNRFNGKATATDKPGTGETKQHPFVSDSSSLSGGFFGPKGEELGFRFLSDDKKVAVVGSAKTKDKTENGAAASGGAGAAASGGAAAMPSENGKLTTVLDAVELTHGGTAIKNLDNFSNAAQLVVDGIMIPLLPEASESGHNQANQGTNGGTAFTRKFDHTPESDKKDAQAGTQTNGAQTASNTAGDTNGKTKTYEVEVCCSNLNYLKYGMLTRKNSKSAMQAGENGSQADAKTEQVEQSMFLQGERTDEKEIPKEQQDIVYRGSWYGHIANDTSWSGNASDREGGNRADFTVNFGTKKINGTLTAENRQEATFTIVGDIKDNGFEGTAKTADSGFDLDQSNTTRTPKAYITDAKVKGGFYGPKAEELGGWFAYPGDKQTEKATVTSGDGNSASSATVVFGAK

SEQ ID NO: 147 - protein, 690 aa, Neisseria meningitidis
CLGGGGSFDLDSVDTEAPRPAPKYQDVSSEKPQAQKDQGGYGFAMRFKRRNLHPMAKENEVKLKNDDWEATGLPTNPKELPKRQESVIEQVKTDDGSNIYSSPYLTQSNHPNGSAGNSVNQPKNQARDYENFQYVYSGWFYKHAAREMDVSTKKFKLGDDGYIFYHGKEPSRQLPVSEKITYKGVWHFVTDTKNGQKFYDIIQSSKKQGDRYSGFSGDEGEEYSNKNEETLKSDHEGYGFTSNLEVDFGNKKLTGKLIRNNASLSNTNNDKHTTQYYSLDATLRGNRFNGTATATDKPEQDGTKQHPFVSDSSSLSGGFFGPQGEELGFRFLSNDKKVAVVGSAKTKDKPRNGAVASGGAGAAASNGAAGTSSENSKLTTVLDAVELTLNDKKIKNLDNFSNAAQLVVDGIMIPLLPQNSTGENNQPDQGKTGGTAFIYKTTYTPKNDDKDTKAQTGAAGSSGAQTASGTESVTGGQAGTKTYEVEVCCSNLNYLKYGLLTRKTASNTGEGGNGSQTAAQTAQGAQSMFLQGERTDEKEIPNDQNVVYRGSWYGYIANDTSWSGNASDKEGGNRAEFTVNFGEKKINGKLTAENRQEATFTIEGMIQGNGFEGTAKTADLGFDLDQSNTTGTPKAYITNAKVQGGFYGPKAEELGGWFAYPGDKQTENTTVASGNGNSASSATVVFGAKR

SEQ ID NO: 148 - protein, 575 aa, Neisseria meningitidis
CLGGGGSFDLDSVETVQDMHSKPKYEDEKSQPESQQDVSENSGAAYGFAVKLPRRNAHFNPKYKEKHKPLGSMDWKKLQRGEPNSFSERDELEKKRGSSELIESKWEDGQSRVVGYTNFTYVRSGYVYLNKNNIDIKNNIVLFGPDGYLYYKGKEPSKELPSEKITYKGTWDYVTDAMEKQRFEGLGSAAGGDKSGALSALEEGVLRNQAEASSGHTDFGMTSEFEVDFSDKTIKGTLYRNNRITQNNSENKQIKTTRYTIQATLHGNRFKGKALAADKGATNGSHPFISDSDSLEGGFYGPKGEELAGKFLSNDNKVAAVFGAKQKDKKDGENAAGPATETVIDAYRITGEEFKKEQIDSFGDVKKLLVDGVELSLLPSEGNKAAFQHEIEQNGVKATVCCSNLDYMSFGKLSKENKDDMFLQGVRTPVSDVAARTEANAKYRGTWYGYIANGTSWSGEASNQEGGNRAEFDVDFSTKKISGTLTAKDRTSPAFTITAMIKDNGFSGVAKTGENGFALDPQNTGNSHYTHIEATVSGGFYGKNAIEMGGSFSFPGNAPEGKQEKASVVFGAKRQ

SEQ ID NO: 149 - DNA, 1707 bp, Neisseria meningitidis
ggatcttctgaaaacagtaagctgaccacggttttggatgcggttgaattgacactaaacgacaagaaaatcaaaaatctcgacaacttcagcaatgccgcccaactggttgtcgacggcattatgattccgctcctgcccaaggattccgaaagcgggaacactcaggcagataaaggtaaaaacggcggaacagaatttacccgcaaatttgaacacacgccggaaagtgataaaaaagacgcccaagcaggtacgcagacgaatggggcgcaaaccgcttcaaatacggcaggtgataccaatggcaaaacaaaaacctatgaagtcgaagtctgctgttccaacctcaattatctgaaatacggaatgttgacgcgcaaaaacagcaagtccgcgatgcaggcaggaggaaacagtagtcaagctgatgctaaaacggaacaagttgaacaaagtatgttcctccaaggcgagcgtaccgatgaaaaagagattccaaccgaccaaaacgtcgtttatcgggggtcttggtacgggcatattgccaacggcacaagctggagcggcaatgcttctgataaagagggcggcaacagggcggaatttactgtgaattttgccgataaaaaaattaccggcaagttaaccgctgaaaacaggcaggcgcaaacctttaccattgagggaatgattcagggcaacggctttgaaggtacggcgaaaactgctgagtcaggttttgatctcgatcaaaaaaataccacccgcacgcctaaggcatatatcacagatgccaaggtaaagggcggtttttacgggcctaaagccgaagagttgggcggatggtttgcctatccgggcgataaacaaacggaaaaggcaacagctacatccagcgatggaaattcagcaagcagcgcgaccgtggtattcggtgcgaaacgccaacagcctgtgcaaggggaaaacgcggcagggcctgcaacggaaaccgtgatagatgcataccgtattaccggcgaggagtttaagaaagagcaaatagacagttttggagatgtgaaaaagctgctggttgacggagtggagctttcactgctgccgtctgagggcaataaggcggcatttcagcacgagattgagcaaaacggcgtgaaggcaacggtgtgttgttccaacttggattacatgagttttgggaagctgtcaaaagaaaataaagacgatatgttcctgcaaggtgtccgcactccagtatccgatgtggcggcaaggacggaggcaaacgccaaatatcgcggtacttggtacggatatattgccaacggcacaagctggagcggcgaagcctccaatcaggaaggtggtaatagggcagagtttgacgtggatttttccactaaaaaaatcagtggcacactgacggcaaaagaccgtacgtctcctgcgtttactattactgccatgattaaggacaacggtttttcaggtgtggcgaaaaccggtgaaaacggctttgcgctggatccgcaaaataccggaaattcccactatacgcatattgaagccactgtatccggcggtttctacggcaaaaacgccatcgagatgggcggatcgttctcatttccgggaaatgcaccagagggaaaacaagaaaaagcatcggtggtattcggtgcgaaacgccaacagcttgtgcaa

SEQ ID NO: 150 - protein, 569 aa, Neisseria meningitidis
GSSENSKLTTVLDAVELTLNDKKIKNLDNFSNAAQLVVDGIMIPLLPKDSESGNTQADKGKNGGTEFTRKFEHTPESDKKDAQAGTQTNGAQTASNTAGDTNGKTKTYEVEVCCSNLNYLKYGMLTRKNSKSAMQAGGNSSQADAKTEQVEQSMFLQGERTDEKEIPTDQNVVYRGSWYGHIANGTSWSGNASDKEGGNRAEFTVNFADKKITGKLTAENRQAQTFTIEGMIQGNGFEGTAKTAESGFDLDQKNTTRTPKAYITDAKVKGGFYGPKAEELGGWFAYPGDKQTEKATATSSDGNSASSATVVFGAKRQQPVQGENAAGPATETVIDAYRITGEEFKKEQIDSFGDVKKLLVDGVELSLLPSEGNKAAFQHEIEQNGVKATVCCSNLDYMSFGKLSKENKDDMFLQGVRTPVSDVAARTEANAKYRGTWYGYIANGTSWSGEASNQEGGNRAEFDVDFSTKKISGTLTAKDRTSPAFTITAMIKDNGFSGVAKTGENGFALDPQNTGNSHYTHIEATVSGGFYGKNAIEMGGSFSFPGNAPEGKQEKASVVFGAKRQQLVQ

SEQ ID NO: 151 - DNA, 2733 bp, Neisseria meningitidis
atgcaacagcaacatttgttccgattaaatattttatgcctgtcgctgatgactgcgctgcctgcttatgcagaaaatgtgcaagccggacaagcacaggaaaaacagttggataccatacaggtaaaagccaaaaaacagaaaacccgccgcgataacgaagtaaccggtctgggcaaattggtcaaaaccgccgacaccctcagcaaggaacaggtactcgatatccgcgacctgacgcgttacgaccccggcatcgccgtggtcgaacaggggcgcggcgcaagttcgggctactcgatacgcggtatggacaaaaaccgcgtttccttgacggtggacggcttggcgcaaatacagtcctacaccgcgcaggcggcattgggcgggacgaggacggcgggcagcagcggcgcaatcaatgaaatcgagtatgaaaacgtcaaagctgtcgaaatcagcaaaggctcaaactcggtcgaacaaggcagcggcgcattggcgggttcggtcgcatttcaaaccaaaaccgccgacgatgttatcggggaaggcaggcagtggggcattcagagtaaaaccgcctattccggcaaaaaccgggggcttacccaatccatcgcgctggcggggcgcatcggcggtgcggaggctttgctgatccacaccgggcggcgcgcgggggaaatccgcgcacacgaagatgccggacgcggcgttcagagctttaacaggctggtgccggttgaagacagcagcgaatacgcctatttcatcgttgaagatgaatgcgaaggcaaaaattacgaaacgtgtaaaagcaaaccgaaaaaagatgttgtcggcaaagacgaacgtcaaacggtttccacccgagactacacgggccccaaccgcttcctcgccgatccgctttcatacgaaagccgatcgtggctgttccgcccgggttttcgttttgaaaacaaacggcactacatcggcggcatactcgaacacacgcaacaaactttcgacacgcgcgatatgacggttccggcattcctgaccaaggcggtttttgatgcaaattcaaaacaggcgggttctttgcccggcaacggcaaatacgcgggcaaccacaaatacggcggactgtttaccaacggcgaaaacggtgcgctggtgggcgcggaatacggtacgggcgtgttttacgacgagacgcacaccaaaagccgctacggtttggaatatgtctataccaatgccgataaagacacttgggcggattatgcccgcctctcttacgaccggcagggcatcggtttggacaatcattttcagcagacgcactgttctgccgacggttcggacaaatattgccgcccgagtgccgacaagccgttttcctattacaaatccgaccgcgtgatttacggggaaagccacaggctcttgcaggcggcattcaaaaaatccttcgataccgccaaaatccgccacaacctgagcgtgaatctcgggtttgaccgctttgactctaatctccgccatcaggattattattatcaacatgccaaccgcgcctattcgtcgaaaacgccccctaaaaccgccaaccccaacggcgacaagagcaaaccctattgggtcagcataggcgggggaaatgtggttacggggcaaatctgcctctttggcaacaatacttatacggactgcacgccgcgcagcatcaacggcaaaagctattacgcggcagttcgggacaatgtccgtttgggcaggtgggcggatgtcggcgcggggttgcgctacgactaccgcagcacgcattcggacgacggcagcgtttccaccggcacgcaccgcaccctgtcctggaacgccggcatcgtcctcaaacctgccgactggctggatttgacttaccgcacttcaaccggcttccgcctgccctcgtttgcggaaatgtacggctggcggtcgggtgttcaaagcaaggcggtcaaaatcgatccggaaaaatcgttcaacaaagaagccggcatcgtgtttaaaggcgatttcggcaacttggaggcaagttggttcaacaatgcctaccgcgatttgattgtccggggttatgaagcgcaaattaaaaacggcaaagaagaagccaaaggcgacccggcttacctcaatgcccaaagcgcgcggattaccggcatcaatattttgggcaaaatcgattggaacggcgtatgggataaattgcccgaaggttggtattctacatttgcctataatcgtgtccatgtccgcgacatcaaaaaacgcgcagaccgcaccgatattcaatcacacctgtttgatgccatccaaccctcgcgctatgtcgtcggcttgggctatgaccaaccggaaggcaaatggggtgtgaacggtatgctgacttattccaaagccaaggaaatcacagagttgttgggcagccgggctttgctcaacggcaacagccgcaatacaaaagccaccgcgcgccgtacccgcccttggtatattgtggatgtgtccggttattacacgattaaaaaacacttcaccctccgtgcgggcgtgtacaacctcctcaactaccgctatgttacttgggaaaatgtgcggcaaactgccggcggcgcagtcaaccaacacaaaaatgtcggcgtttacaaccgatatgccgcccccggccgaaactacacatttagcttggaaatgaagttt

SEQ ID NO: 152 - protein, 911 aa, Neisseria meningitidis
MQQQHLFRLNILCLSLMTALPAYAENVQAGQAQEKQLDTIQVKAKKQKTRRDNEVTGLGKLVKTADTLSKEQVLDIRDLTRYDPGIAVVEQGRGASSGYSIRGMDKNRVSLTVDGLAQIQSYTAQAALGGTRTAGSSGAINEIEYENVKAVEISKGSNSVEQGSGALAGSVAFQTKTADDVIGEGRQWGIQSKTAYSGKNRGLTQSIALAGRIGGAEALLIHTGRRAGEIRAHEDAGRGVQSFNRLVPVEDSSEYAYFIVEDECEGKNYETCKSKPKKDVVGKDERQTVSTRDYTGPNRFLADPLSYESRSWLFRPGFRFENKRHYIGGILEHTQQTFDTRDMTVPAFLTKAVFDANSKQAGSLPGNGKYAGNHKYGGLFTNGENGALVGAEYGTGVFYDETHTKSRYGLEYVYTNADKDTWADYARLSYDRQGIGLDNHFQQTHCSADGSDKYCRPSADKPFSYYKSDRVIYGESHRLLQAAFKKSFDTAKIRHNLSVNLGFDRFDSNLRHQDYYYQHANRAYSSKTPPKTANPNGDKSKPYWVSIGGGNVVTGQICLFGNNTYTDCTPRSINGKSYYAAVRDNVRLGRWADVGAGLRYDYRSTHSDDGSVSTGTHRTLSWNAGIVLKPADWLDLTYRTSTGFRLPSFAEMYGWRSGVQSKAVKIDPEKSFNKEAGIVFKGDFGNLEASWFNNAYRDLIVRGYEAQIKNGKEEAKGDPAYLNAQSARITGINILGKIDWNGVWDKLPEGWYSTFAYNRVHVRDIKKRADRTDIQSHLFDAIQPSRYVVGLGYDQPEGKWGVNGMLTYSKAKEITELLGSRALLNGNSRNTKATARRTRPWYIVDVSGYYTIKKHFTLRAGVYNLLNYRYVTWENVRQTAGGAVNQHKNVGVYNRYAAPGRNYTFSLEMKF

SEQ ID NO: 153 - DNA, 760 bp, Neisseria meningitidis
ggatcctcgtctgaaaacagtaagctgaccacggttttggatgcggttgaattgacactaaacgacaagaaaatcaaaaatctcgacaacttcagcaatgccgcccaactggttgtcgacggcattatgattgatctggccggaacagaatttacccgcaaatttgaacacacggccaaggaaatcacagagttgttgggcagccgggctttgctcaacggcaacagccgcaatacaaaagccaccgcgcgccgtacccgcacctatgaagtcgaagtctgctgttccaaaacaaagtatgttcctccaaggcgagcgtaccgatgaaaaagagattccaaccgaccaaaacgtcgtttatcgggggtcttggtacgggcatattgccaacggcacaagctggagcggcaatgcttctgataaagagggcggcaacagggcggaatttactgtgaattttgccgataaaaaaattaccggcaagttaaccgctgaaaacaggcaggcgcaaacctttaccattgagggaatgattcagggcaacggctttgaaggtacggcgaaaactgctgagtcaggttttgatctcgatcaaaaaaataccacccgcacgcctaaggcatatatcacagatgccaaggtaaagggcggtttttacgggcctaaagccgaagagttgggcggatggtttgcctatcataaaagcgataacggcagcgcgaccgtggtattcggtgcgaaacgccaacagcctgtgcaa

SEQ ID NO: 154 - protein, 270 aa, Neisseria meningitidis
GSSSENSKLTTVLDAVELTLNDKKIKNLDNFSNAAQLVVDGIMIDLAGTEFTRKFEHTAKEITELLGSRALLNGNSRNTKATARRTRTYEVEVCCSNLNYLKYGMLTRKGKQVEQSMFLQGERTDEKEIPTDQNVVYRGSWYGHIANGTSWSGNASDKEGGNRAEFTVNFADKKITGKLTAENRQAQTFTIEGMIQGNGFEGTAKTAESGFDLDQKNTTRTPKAYITDAKVKGGFYGPKAEELGGWFAYHKSDNGSATVVFGAKRQQPVQ

SEQ ID NO: 155 - DNA, 807 bp, Neisseria meningitidis
ggatcctcgtctgaaaacagtaagctgaccacggttttggatgcggttgaattgacactaaacgacaagaaaatcaaaaatctcgacaacttcagcaatgccgcccaactggttgtcgacggcattatgattgatctggccggaacagaatttacccgcaaatttgaacacacgattaacggcaaaacctatgaagtcgaagtctgctgttccaacctcaattatctgaaatacggaatgttgacgcgcaaagttacttgggaaaatgtgcggcaaactgccggcggcgcagtcaaccaacacaaaaatgtcggcgtttacaaccgatatgccgttgaacaaagtatgttcctccaaggcgagcgtaccgatgaaaaagagattccaaccgaccaaaacgtcgtttatcgggggtcttggtacgggcatattgccaacggcacaagctggagcggcaatgcttctgataaagagggcggcaacagggcggaatttactgtgaattttgccgataaaaaaattaccggcaagttaaccgctgaaaacaggcaggcgcaaacctttaccattgagggaatgattcagggcaacggctttgaaggtacggcgaaaactgctgagtcaggttttgatctcgatcaaaaaaataccacccgcacgcctaaggcatatatcacagatgccaaggtaaagggcggtttttacgggcctaaagccgaagagttgggcggatggtttgcctatcataaaagcgataacggcagcgcgaccgtggtattcggtgcgaaacgccaacagcctgtgcaa

SEQ ID NO: 156 - protein, 269 aa, Neisseria meningitidis
GSSSENSKLTTVLDAVELTLNDKKIKNLDNFSNAAQLVVDGIMIDLAGTEFTRKFEHTINGKTYEVEVCCSNLNYLKYGMLTRKVTWENVRQTAGGAVNQHKNVGVYNRYAVEQSMFLQGERTDEKEIPTDQNVVYRGSWYGHIANGTSWSGNASDKEGGNRAEFTVNFADKKITGKLTAENRQAQTFTIEGMIQGNGFEGTAKTAESGFDLDQKNTTRTPKAYITDAKVKGGFYGPKAEELGGWFAYHKSDNGSATVVFGAKRQQPVQ

SEQ ID NO: 157 - DNA, 759 bp, Neisseria meningitidis
ggatcctcgtctgaaaacagtaagctgaccacggttttggatgcggttgaattgacactaaacgacaagaaaatcaaaaatctcgacaacttcagcaatgccgcccaactggttgtcgacggcattatgattgatctggccggaacagaatttacccgcaaatttgaacacacgattaacggcaaaacctatgaagtcgaagtctgctgttccaacctcaattatctgaaatacggaatgttgacgcgcaaaggcaaacaggttgaacaaagtatgttcctccaaggcgagcgtaccgatgaaaaagagattccaaccgaccaaaacgtcgtttatcgggggtcttggtacgggcatattgccaacggcacaagctggagcggcaatgcttctgataaagagggcggcaacagggcggaatttactgtgaattttgccgataaaaaaattaccggcaagttaaccgctgaaaacaggcaggcgcaaacctttaccattgagggaatgattcagggcaacggctttgaaggtacggcgaaaactgctgagtcaggttttgatctcgatcaaaaaaataccacccgcacgcctaaggcatatatcacagatgccaaggtaaagggcggtttttacgggcctaaagccgaagagttgggcggatggtttgcctataccgcgcaggcggcattgggcgggacgaggacggcgggcagcagcgcgaccgtggtattcggtgcgaaacgccaacagcctgtgcaa

SEQ ID NO: 158 - protein, 253 aa, Neisseria meningitidis
GSSSENSKLTTVLDAVELTLNDKKIKNLDNFSNAAQLVVDGIMIDLAGTEFTRKFEHTINGKTYEVEVCCSNLNYLKYGMLTRKGKQVEQSMFLQGERTDEKEIPTDQNVVYRGSWYGHIANGTSWSGNASDKEGGNRAEFTVNFADKKITGKLTAENRQAQTFTIEGMIQGNGFEGTAKTAESGFDLDQKNTTRTPKAYITDAKVKGGFYGPKAEELGGWFAYTAQAALGGTRTAGSSATVVFGAKRQQPVQ

SEQ ID NO: 159 - DNA, 774 bp, Neisseria meningitidis
ggatcctcgtctgaaaacagtaagctgaccacggttttggatgcggttgaattgacactaaacgacaagaaaatcaaaaatctcgacaacttcagcaatgccgcccaactggttgtcgacggcattatgattccactcctcccagccacaaaagccgtctttgatgagaaccgcaaatacggcccggaatttacccgcaaatttgaacacacgattaacggcaaaacctatgaagtcgaagtctgctgttccaacctcaattatctgaaatacggaatgttgacgcgcaaaggcaaacaggttgaacaaagtatgttcctccaaggcgagcgtaccgatgaaaaagagattccaaccgaccaaaacgtcgtttatcgggggtcttggtacgggcatattgccaacggcacaagctggagcggcaatgcttctgataaagagggcggcaacagggcggaatttactgtgaattttgccgataaaaaaattaccggcaagttaaccgctgaaaacaggcaggcgcaaacctttaccattgagggaatgattcagggcaacggctttgaaggtacggcgaaaactgctgagtcaggttttgatctcgatcaaaaaaataccacccgcacgcctaaggcatatatcacagatgccaaggtaaagggcggtttttacgggcctaaagccgaagagttgggcggatggtttgcctatcataaaagcgataacggcagcgcgaccgtggtattcggtgcgaaacgccaacagcctgtgcaa

SEQ ID NO: 160 - protein, 258 aa, Neisseria meningitidis
GSSSENSKLTTVLDAVELTLNDKKIKNLDNFSNAAQLVVDGIMIPLLPATKAVFDENRKYGPEFTRKFEHTINGKTYEVEVCCSNLNYLKYGMLTRKGKQVEQSMFLQGERTDEKEIPTDQNVVYRGSWYGHIANGTSWSGNASDKEGGNRAEFTVNFADKKITGKLTAENRQAQTFTIEGMIQGNGFEGTAKTAESGFDLDQKNTTRTPKAYITDAKVKGGFYGPKAEELGGWFAYHKSDNGSATVVFGAKRQQPVQ

SEQ ID NO: 161 - DNA, 2832 bp, Neisseria meningitidis
atgaataagaaacacggttttccgctgactctgactgccttggccattgcaaccgcttttccggcttatgctgcccaagcggggggggcgacacctgatgccgcgcagacccaatccctgaaagagattaccgtccgtgccgccaaagtgggacggcgatcgaaagaggcgaccggtttgggcaaaatcgtcaaaacgtcggaaacgttgaacaaagaacaggtactcggtatccgcgacctgacgcgctacgatccgggcgtggcggttgtcgaacagggcaacggcgcgagcggcggctactcgatacgcggcgtggataaaaaccgtgtggcggtttcggtcgacggtgttgcccaaatacaggcgtttaccgtgcagggatcgttgagcggatacggcggacgcggcggcagcggtgcaatcaacgaaatcgaatatgaaaacatcagcacggtggaaatcgacaaaggtgccggttcgtccgatcacggcagcggcgcactcggcggcgcggtcgccttccgcaccaaagaggcggcagacctgatttcagacggcaaaagttgggggatacaggcaaaaaccgcctacggcagtaaaaaccgccaatttatgaagtcgctcggcgcggggttcagcaaagacggttgggaagggctgttaatccgaaccgaacgccaagggcgggaaacgcgcccgcacggcgatattgcggacggggtggaatacggcatagaccgtttggacgcgttccgtcagacatacgatattaaacgcaagacaagagagccatttttctcagtagagggcgagcgtgaatccaagcccgtggcaaaattggcgggctacgggaaatatttgaacaaccagctcaaccgctgggtaaaagaacgtattgaacaaaatcagcctttaagtgctgaagaagaggcgcaggtgcgggaggcgcaggcgcgccacgaaaatctgtccgcccaagcttacacgggcggcggcaggatattgcccgatccgatggattaccgcagcggctcttggcttgccaagctgggctaccgcttcggcggcaggcattatgtcggcggcgtgtttgaggataccaaacagcgttacgatatccgcgatatgacggaaaaacagtattacggtacggacgaggcggaaaagtttagagacaagagcggggtgtacgacggcgacgatttccgcgacggcttgtattttgtgccgaatatagaagagtggaagggcgataaaaatttggtcaggggcataggtttgaaatattcccgcaccaaatttattgacgaacatcaccgccgccgccgtatgggtttgctgtatcgttatgaaaacgaagcgtattctgacaattgggcggataaggcggtgttgtcgtttgacaaacagggcgtggcaaccgataacaacacgctgaagctgaattgcgccgtgtatcctgctgtggacaaatcctgccgcgcgtcggcggacaaaccgtattcctacgacagcagcgaccgtttccactaccgcgaacagcacaatgttttgaatgcctcgtttgagaaatcgctgaaaaacaaatggacgaaacaccatctgactttgggcttcggttacgatgcttccaaagcgatttcccgccccgaacagctttcccacaatgcggcaaggatttcggaatccacgggattcgatgaaaacaatcaagataagtatcttttgggtaagcccgaagtcgtcgaagggtcggtctgcggctacatcgaaaccctgcgttcccgcaaatgcgtgccaagaaaaatcaacggcagcaatatccatatttctttgaacgaccgtttttcaatcggcaaatatttcgatttcagcttgggcggcaggtacgaccggaaaaacttcaccacgtcggaagaactcgtccgcagcgggcggtatgttgaccgttcgtggaacagcggcatcttgttcaaaccgaaccggcatttttccgtgtcttaccgtgcctccagcggcttcagaacgccctcattccaagaacttttcgggatagacatttatcacgattatccgaaaggctggcagcgtcccgccctgaaatcggaaaaggcagccaaccgggaaatcggtttgcagtggaagggcgatttcggctttttggaaatcagcagcttccgcaaccgttataccgatatgattgccgttgccgatcacaaaaccaaattgccgaatcaggcaggacaattgacagagattgatatacgcgattattacaatgcccaaaatatgtcgcttcaaggcgttaatatattgggaaaaatcgactggaacggcgtgtatggcaaactgcccgaaggtttgtacaccacattggcgtacaaccgcatcaaaccgaaatcggtatccaaccggccgggactgtccctccgcagctatgctttggatgcggtacagccgtcgcgttatgttttggggttcggatacgaccagcctgaggggaaatggggcgcaaacattatgctgacctattccaaagggaaaaaccctgacgagcttgcttatctggcaggcgatcaaaaacgatattcgacaaaaagagcgtcgtcttcttggtcgacggcagacgtttccgcctatctgaatctgaaaaaacggctgaccttgagggcggctatctacaatatcggcaactaccgctacgttacttgggaatccttgcgccagactgcggaaagcacggcaaaccggcacggcggcgacagcaactatggaaggtatgccgcaccgggcaggaacttcagtctcgcgctcgaaatgaagttttaa

SEQ ID NO: 162 - protein, 943 aa, Neisseria meningitidis
MNKKHGFPLTLTALAIATAFPAYAAQAGGATPDAAQTQSLKEITVRAAKVGRRSKEATGLGKIVKTSETLNKEQVLGIRDLTRYDPGVAVVEQGNGASGGYSIRGVDKNRVAVSVDGVAQIQAFTVQGSLSGYGGRGGSGAINEIEYENISTVEIDKGAGSSDHGSGALGGAVAFRTKEAADLISDGKSWGIQAKTAYGSKNRQFMKSLGAGFSKDGWEGLLIRTERQGRETRPHGDIADGVEYGIDRLDAFRQTYDIKRKTREPFFSVEGERESKPVAKLAGYGKYLNNQLNRWVKERIEQNQPLSAEEEAQVREAQARHENLSAQAYTGGGRILPDPMDYRSGSWLAKLGYRFGGRHYVGGVFEDTKQRYDIRDMTEKQYYGTDEAEKFRDKSGVYDGDDFRDGLYFVPNIEEWKGDKNLVRGIGLKYSRTKFIDEHHRRRRMGLLYRYENEAYSDNWADKAVLSFDKQGVATDNNTLKLNCAVYPAVDKSCRASADKPYSYDSSDRFHYREQHNVLNASFEKSLKNKWTKHHLTLGFGYDASKAISRPEQLSHNAARISESTGFDENNQDKYLLGKPEVVEGSVCGYIETLRSRKCVPRKINGSNIHISLNDRFSIGKYFDFSLGGRYDRKNFTTSEELVRSGRYVDRSWNSGILFKPNRHFSVSYRASSGFRTPSFQELFGIDIYHDYPKGWQRPALKSEKAANREIGLQWKGDFGFLEISSFRNRYTDMIAVADHKTKLPNQAGQLTEIDIRDYYNAQNMSLQGVNILGKIDWNGVYGKLPEGLYTTLAYNRIKPKSVSNRPGLSLRSYALDAVQPSRYVLGFGYDQPEGKWGANIMLTYSKGKNPDELAYLAGDQKRYSTKRASSSWSTADVSAYLNLKKRLTLRAAIYNIGNYRYVTWESLRQTAESTANRHGGDSNYGRYAAPGRNFSLALEMKF

SEQ ID NO: 163 - DNA, 768 bp, Neisseria meningitidis
ggatcctcgtctgaaaacagtaagctgaccacggttttggatgcggttgaattgacactaaacgacaagaaaatcaaaaatctcgacaacttcagcaatgccgcccaactggttgtcgacggcattatgattgatctggccggaacagaatttacccgcaaatttgaacacacgctcaaccgctgggtaaaagaacgtattgaacaaaatcagcctttaacctatgaagtcgaagtctgctgttccaacctcaattatctgaaatacggaatgttgacgcgcaaaggcaaacaggttgaacaaagtatgttcctccaaggcgagcgtaccgatgaaaaagagattccaaccgaccaaaacgtcgtttatcgggggtcttggtacgggcatattgccaacggcacaagctggagcggcaatgcttctgataaagagggcggcaacagggcggaatttactgtgaattttgccgataaaaaaattaccggcaagttaaccgctgaaaacaggcaggcgcaaacctttaccattgagggaatgattcagggcaacggctttgaaggtacggcgaaaactgctgagtcaggttttgatctcgatcaaaaaaataccacccgcacgcctaaggcatatatcacagatgccaaggtaaagggcggtttttacgggcctaaagccgaagagttgggcggatggtttgcctatcataaaagcgataacggcagcgcgaccgtggtattcggtgcgaaacgccaacagcctgtgcaa

SEQ ID NO: 164 - protein, 256 aa, Neisseria meningitidis
GSSSENSKLTTVLDAVELTLNDKKIKNLDNFSNAAQLVVDGIMIDLAGTEFTRKFEHTLNRWVKERIEQNQPLTYEVEVCCSNLNYLKYGMLTRKGKQVEQSMFLQGERTDEKEIPTDQNVVYRGSWYGHIANGTSWSGNASDKEGGNRAEFTVNFADKKITGKLTAENRQAQTFTIEGMIQGNGFEGTAKTAESGFDLDQKNTTRTPKAYITDAKVKGGFYGPKAEELGGWFAYHKSDNGSATVVFGAKRQQPVQ

SEQ ID NO: 165 - DNA, 777 bp, Neisseria meningitidis
ggatcctcgtctgaaaacagtaagctgaccacggttttggatgcggttgaattgacactaaacgacaagaaaatcaaaaatctcgacaacttcagcaatgccgcccaactggttgtcgacggcattatgattccactcctcccatacggtacggacgaggcggaaaagtttagagacaagagcggggtggaatttacccgcaaatttgaacacacgattaacggcaaaacctatgaagtcgaagtctgctgttccaacctcaattatctgaaatacggaatgttgacgcgcaaaggcaaacaggttgaacaaagtatgttcctccaaggcgagcgtaccgatgaaaaagagattccaaccgaccaaaacgtcgtttatcgggggtcttggtacgggcatattgccaacggcacaagctggagcggcaatgcttctgataaagagggcggcaacagggcggaatttactgtgaattttgccgataaaaaaattaccggcaagttaaccgctgaaaacaggcaggcgcaaacctttaccattgagggaatgattcagggcaacggctttgaaggtacggcgaaaactgctgagtcaggttttgatctcgatcaaaaaaataccacccgcacgcctaaggcatatatcacagatgccaaggtaaagggcggtttttacgggcctaaagccgaagagttgggcggatggtttgcctatcataaaagcgataacggcagcgcgaccgtggtattcggtgcgaaacgccaacagcctgtgcaa

SEQ ID NO: 166 - protein, 259 aa, Neisseria meningitidis
GSSSENSKLTTVLDAVELTLNDKKIKNLDNFSNAAQLVVDGIMIPLLPYGTDEAEKFRDKSGVEFTRKFEHTINGKTYEVEVCCSNLNYLKYGMLTRKGKQVEQSMFLQGERTDEKEIPTDQNVVYRGSWYGHIANGTSWSGNASDKEGGNRAEFTVNFADKKITGKLTAENRQAQTFTIEGMIQGNGFEGTAKTAESGFDLDQKNTTRTPKAYITDAKVKGGFYGPKAEELGGWFAYHKSDNGSATVVFGAKRQQPVQ

SEQ ID NO: 167 - DNA, 1062 bp, Haemophilus influenzae
ggatccgcgaccaccagcaccaccgcgaacgcgaaaaccgatgcgaccaccaacgcggaaaactttaccaccaaagatattagcagctttggcgaagcggattatctgctgattgataactatccggtgccgctgctgccggaaaccgaaaacagcggcgattttgcgaccagcaaacattatgaagtgcgcgataaaacctataaagtggaagcgtgctgcaaaaacctgagctatgtgaaatttggcatgtattatgaaaccaaacgcccggcggcgaaaccgaaagcgcagaaaaaaaaacgcaaaaaaaaaaaaaccggcgtgaaaagcgtgaaaaaaggcaaaaaaaaaattaaaaaaaaaaaaggcaccaaaaaagcggcggtgaaaaaaaaaggcagcaaaaaaaaagcggtgaaaggcaaaaaaaaagcgaaaaaaccgaaaaaaaaaagcccgaccaaaaaaggcggcagcggcagcaaaggcattctgccggcgccgaaagcgccgaaaggccgcaacattaaatatcatcagtttctgctgggcctgcgcaccgcgagcagcaaaattccgaccaccggcaacgtgaaatatcgcggcagctggtttggctatattagcgatggcgaaaccagctatagcaccaccggcgataaacgccaggataaaaacgcggtggcggaatttgatgtgaactttgcggaaaaaaccctgaaaggcagcctgaaacgcgcggatagccagaacccggtgtttagcattgaagcgaactttaaaaacggcggcaacgcgtttaccggcaccgcgaccgcgaaagatctggtgattgatggcaaaaacagccagaccaaaaacaccccgattaacattaccaccaaagtgaacggcgcgttttatggcccgaacgcgagcgaactgggcggctattttacctataacggcaaaaacccgaccgataaaaacagcccgaccgcgagcagcccgagcaacagcgaaaaagcgcgcgcggcggtggtgtttggcgcgaaaaaacaggtggaaaccaacaacaaa

SEQ ID NO: 168 - protein, 354 aa, Haemophilus influenzae
GSATTSTTANAKTDATTNAENFTTKDISSFGEADYLLIDNYPVPLLPETENSGDFATSKHYEVRDKTYKVEACCKNLSYVKFGMYYETKRPAAKPKAQKKKRKKKKTGVKSVKKGKKKIKKKKGTKKAAVKKKGSKKKAVKGKKKAKKPKKKSPTKKGGSGSKGILPAPKAPKGRNIKYHQFLLGLRTASSKIPTTGNVKYRGSWFGYISDGETSYSTTGDKRQDKNAVAEFDVNFAEKTLKGSLKRADSQNPVFSIEANFKNGGNAFTGTATAKDLVIDGKNSQTKNTPINITTKVNGAFYGPNASELGGYFTYNGKNPTDKNSPTASSPSNSEKARAAVVFGAKKQVETNNK

SEQ ID NO: 169 - DNA, 1614 bp, Haemophilus parasuis
tgttctggcggaaaaggaagttttgatttagaagatgttcagcctaataagacaacgggcgtgtctaaagaagagtataaggatgtggaaacggataagaaagtaaaagaacagttaggggaattgatggaacctgctttggggtatgttgtaaaagttccagtgagtcaaagtggagtaaaaagaacggaaatctcaaatccagaagcaattactgatgaagatcttaataaaataccaaattacgagattatcaaaggtgtagcttatccaaatgcgggcgagctagtagataaaacagcagctgagacgatgaaatatgttcgttctggttatgtaattgatgtatatcattctggtactcgtgataaaggttatgtgttttataaaggtattactccctcaaaagaattaccgcaggggccagcccttacctaccaaggtgaatgggattttacctcagatgctaatttaaataatgaagagggaagacctacttatttaaacgacgattattatactacatggataggtaaacgggcgggcttggtttcgggagatgcgaaaccttcaaagcataaatacacaagccagtttaaagttgattttgcaactaaaaaaatgacaggtaagttatccgataaagagaaaacgatttatacagtcaatgctgatattagaggtaatcgttttacgggttctgctacagcaagtgataaagacaaagggaaaggtgcatcatataacttctttagtgtcgattctcagtctttagaaggcggcttctatggtccaaaagcggaagaaatggcaggtaaatttgtagccgacgacaaatctctttttgccgttttttcagcaaaacacaatgcttctaatgttaacaccgttcgtattattgatgcctcaaaaattgatttaactaatttcagcatttcagaacttaccaattttggcgatgcttctgttttaattattgatgggaaaaaaatggagctagctggtagcgagtttacaaataagcacactattgatatcaatggtaaaaaaatggtagctgtagcctgctgtagtaatttggaatatatgaaatttggtcaattatggcagcaaacagagggcgaaaaacaagttaaagataatagtttattcctacaaggcgaacgtactgcaacagataagatgccaaaagacggaaactataaatatattggtacttgggatgctcaggtttcaaaagaaaataattactgggttgctacggcagatgatgatagaaaagctggctaccgcacagaatttgatgttgattttggcagcaaaaatttaagtggtaagttatttgataaaaacggtgtaaatcctgtgtttaccgtaaatgcaaaaattgatggtaatggttttactggcgaagctaaaacctcagatgctggcttcgttctagatccaggtagtttacgtcatgacaatgtgaaatttagcgatgtagcagttagtggtggcttctatggtccaacggcagcagagcttggcggacaattccgttatcaatcagacaatggcagtgtaggtgtaggtgctgtctttggtgcaaaacaacaagtaaaaaaataa

SEQ ID NO: 170 - protein, 537 aa, Haemophilus parasuis
CSGGKGSFDLEDVQPNKTTGVSKEEYKDVETDKKVKEQLGELMEPALGYVVKVPVSQSGVKRTEISNPEAITDEDLNKIPNYEIIKGVAYPNAGELVDKTAAETMKYVRSGYVIDVYHSGTRDKGYVFYKGITPSKELPQGPALTYQGEWDFTSDANLNNEEGRPTYLNDDYYTTWIGKRAGLVSGDAKPSKHKYTSQFKVDFATKKMTGKLSDKEKTIYTVNADIRGNRFTGSATASDKDKGKGASYNFFSVDSQSLEGGFYGPKAEEMAGKFVADDKSLFAVFSAKHNASNVNTVRIIDASKIDLTNFSISELTNFGDASVLIIDGKKMELAGSEFTNKHTIDINGKKMVAVACCSNLEYMKFGQLWQQTEGEKQVKDNSLFLQGERTATDKMPKDGNYKYIGTWDAQVSKENNYWVATADDDRKAGYRTEFDVDFGSKNLSGKLFDKNGVNPVFTVNAKIDGNGFTGEAKTSDAGFVLDPGSLRHDNVKFSDVAVSGGFYGPTAAELGGQFRYQSDNGSVGVGAVFGAKQQVKK

SEQ ID NO: 171 - DNA, 1614 bp, Haemophilus parasuis
tgttctggcggaaaaggaagttttgatttagaagatgttcagcctaataagacaacgggcgtgtctaaagaagagtataaggatgtggaaacggataagaaagtaaaagaacagttaggggaattgatggaacctgctttggggtatgttgtaaaagttccagtgagtcaaagtggagtaaaaagaacggaaatctcaaatccagaagcaattactgatgaagatcttaataaaataccaaattacgagattatcaaaggtgtagcttatccaaattatggcgagctagtagataaaacagcagctgagacgatgaaatatgttcgttctggttatgtaattgatgtatatcattctggtactcgtgataaaggttatgtgttttataaaggtattactccctcaaaagaattaccgcaggggccagcccttacctaccaaggtgaatgggattttacctcagatgctaatttaaataatgaagagggaagacctacttatttaaacgacgattattatactacatggataggtaaacgggcgggcttggtttcgggagatgcgaaaccttcaaagcataaatacacaagccagtttaaagttgattttgcaactaaaaaaatgacaggtaagttatccgataaagagaaaacgatttatacagtcaatgctgatattagaggtaatcgttttacgggttctgctacagcaagtgataaagacaaagggaaaggtgcatcatataacttctttagtgtcgattctcagtctttagaaggcggcttctatggtccaaaagcggaagaaatggcaggtaaatttgtagccgacgacaaatctctttttgccgttttttcagcaaaacacaatgcttctaatgttaacaccgttcgtattattgatgcctcaaaaattgatttaactaatttcagcatttcagaacttaccaattttggcgatgcttctgttttaattattgatgggaaaaaaatggagctagctggtagcgagtttacaaataagcacactattgatatcaatggtaaaaaaatggtagctgtagcctgctgtagtaatttggaatatatgaaatttggtcaattatggcagcaaacagagggcgaaaaacaagttaaagataatagtttattcctacaaggcgaacgtactgcaacagataagatgccaaaagacggaaactataaatatattggtacttgggatgctcaggtttcaaaagaaaataattactgggttgctacggcagatgatgatagaaaagctggctaccgcacagaatttgatgttgattttggcagcaaaaatttaagtggtaagttatttgataaaaacggtgtaaatcctgtgtttaccgtaaatgcaaaaattgatggtaatggttttactggcgaagctaaaacctcagatgctggcttcgttctagatccaggtagtttacgtcatgacaatgtgaaatttagcgatgtagcagttagtggtggcttctatggtccaacggcagcagagcttggcggacaattccgttatcaatcagacaatggcagtgtaggtgtaggtgctgtctttggtgcaaaacaacaagtaaaaaaataa

SEQ ID NO: 172 - protein, 537 aa, Haemophilus parasuis
CSGGKGSFDLEDVQPNKTTGVSKEEYKDVETDKKVKEQLGELMEPALGYVVKVPVSQSGVKRTEISNPEAITDEDLNKIPNYEIIKGVAYPNYGELVDKTAAETMKYVRSGYVIDVAHSGTRDKGYVFYKGITPSKELPQGPALTYQGEWDFTSDANLNNEEGRPTYLNDDYYTTWIGKRAGLVSGDAKPSKHKYTSQFKVDFATKKMTGKLSDKEKTIYTVNADIRGNRFTGSATASDKDKGKGASYNFFSVDSQSLEGGFYGPKAEEMAGKFVADDKSLFAVFSAKHNASNVNTVRIIDASKIDLTNFSISELTNFGDASVLIIDGKKMELAGSEFTNKHTIDINGKKMVAVACCSNLEYMKFGQLWQQTEGEKQVKDNSLFLQGERTATDKMPKDGNYKYIGTWDAQVSKENNYWVATADDDRKAGYRTEFDVDFGSKNLSGKLFDKNGVNPVFTVNAKIDGNGFTGEAKTSDAGFVLDPGSLRHDNVKFSDVAVSGGFYGPTAAELGGQFRYQSDNGSVGVGAVFGAKQQVKK

SEQ ID NO: 173 - DNA, 1614 bp, Haemophilus parasuis; identical to SEQ ID NO: 171

SEQ ID NO: 174 - protein, 537 aa, Haemophilus parasuis
CSGGKGSFDLEDVQPNKTTGVSKEEYKDVETDKKVKEQLGELMEPALGYVVKVPVSQSGVKRTEISNPEAITDEDLNKIPNYEIIKGVAYPNYGELVDKTAAETMKYVRSGYVIDVYHSGTRDKGYVFYKGITPSKELPQGPALTYQGEWDFTSDANLNNEEGRPTALNDDYYTTWIGKRAGLVSGDAKPSKHKYTSQFKVDFATKKMTGKLSDKEKTIYTVNADIRGNRFTGSATASDKDKGKGASYNFFSVDSQSLEGGFYGPKAEEMAGKFVADDKSLFAVFSAKHNASNVNTVRIIDASKIDLTNFSISELTNFGDASVLIIDGKKMELAGSEFTNKHTIDINGKKMVAVACCSNLEYMKFGQLWQQTEGEKQVKDNSLFLQGERTATDKMPKDGNYKYIGTWDAQVSKENNYWVATADDDRKAGYRTEFDVDFGSKNLSGKLFDKNGVNPVFTVNAKIDGNGFTGEAKTSDAGFVLDPGSLRHDNVKFSDVAVSGGFYGPTAAELGGQFRYQSDNGSVGVGAVFGAKQQVKK

SEQ ID NO: 175 - DNA, 1614 bp, Haemophilus parasuis; identical to SEQ ID NO: 171

SEQ ID NO: 176 - protein, 537 aa, Haemophilus parasuis
CSGGKGSFDLEDVQPNKTTGVSKEEYKDVETDKKVKEQLGELMEPALGYVVKVPVSQSGVKRTEISNPEAITDEDLNKIPNYEIIKGVAYPNAGELVDKTAAETMKYVRSGYVIDVYHSGTRDKGYVFYKGITPSKELPQGPALTYQGEWDFTSDANLNNEEGRPTYLNDDYYTTAIGKRAGLVSGDAKPSKHKYTSQFKVDFATKKMTGKLSDKEKTIYTVNADIRGNRFTGSATASDKDKGKGASYNFFSVDSQSLEGGFYGPKAEEMAGKFVADDKSLFAVFSAKHNASNVNTVRIIDASKIDLTNFSISELTNFGDASVLIIDGKKMELAGSEFTNKHTIDINGKKMVAVACCSNLEYMKFGQLWQQTEGEKQVKDNSLFLQGERTATDKMPKDGNYKYIGTWDAQVSKENNYWVATADDDRKAGYRTEFDVDFGSKNLSGKLFDKNGVNPVFTVNAKIDGNGFTGEAKTSDAGFVLDPGSLRHDNVKFSDVAVSGGFYGPTAAELGGQFRYQSDNGSVGVGAVFGAKQQVKK

SEQ ID NO: 177 - protein, 670 aa, Neisseria meningitidis
CLGGGGSFDLDSVDTEAPRPAPKYQDVSSEKPQAQKDQGGYGFAMRLKRRNWYRQANPKEDEIKLSENDWEQTDNGDIKNPSKQKNIINALTGNNGGASLQDSSQENQGISKVTGHHNFQYVWSGFFYKQIGSTFERKDSSITAARSGPDGYIFYKGKDPSRKLPVSGEVMYKGTWDFLTDVKTSQKFTDLGNTSTRPGDRYSAFSGELDYIVNKDSDKKDEHVGWGLTTEITVDFEKKTLSGKLIKNNRVNNDNDKHTTQYYSLDATLRGNRFSGKAEATDKPKNDGETKEHPFVSDSSSLSGGFFGPKGEELGFRFLSDDQKVAVVGSAKTQDKPRNGAVASGGAGAAASNGAAGTSSENSKLTTVLDAVELTLNDKKIKNLDNFSNAAQLVVDGIMIPLLPEASESGKNQANQGTNGGTAFTRKFNHTPKSDEKDTQAGTAENGNPAASNTAGDANGKTKTYEVEVCCSNLNYLKYGMLTRKNSKSAMQAGESSSQADAKTEQVGQSMFLQGERTDEKEIPNDQNVVYRGSWYGHIANGTSWSGNASDKEGGNRADFTVNFGTKKINGTLTADNRQAATFTIVGDIEGNGFSGTAKTADSGFDLDQSNNTRTPKAYITNAKVQGGFYGPKAEELGGWFAYSDDKQTKNATDASGNGNSASSATVVFG

SEQ ID NO: 178 - protein, 680 aa, Neisseria meningitidis
CLGGGGGSFDLDSVDTEAPRPAPKYQDVSSEKPQAPKDQGGYGFAMRFKRRNWYPSAKENEVKLNEGDWEATGLPTEPKELPKRQKSVIEKVETDDDSNIYSSPYLTPSNHQSGSAGNGVNQPKNKATDHENFQYVYSGWFYKHAKQHRDLANKIVQQGDDGYIFYHGKEPSRQLPASGKITYKGVWHFATDVKKSQNFREIIQPSKSQGDRYSGFSGDDGEEYSNKNETTLQSGHEGYGFTSNLEVDFDNKKLTGKLIRNNANTSNNQATTQYYSLDAQITGNRFNGKAMATDKPGTGETKLHPFVSDSSSLSGGFFGPKGEELGFRFLSDDQKVAVVGSAKTQDKPGNGAAASGGTGAAASGGAADMPSENSKLTTVLDAVELTHGGTAIKNLDNFSNAAQLVVDGIMIPLLPEASESGHNQANQGTNGGTAFTRKFNHTPTSDEKDTQAGTAANGNQAASNTAGDANGKTKTYAVEVCCSNLNYLKYGLLTRKTAGNTGEGGNGSQTAAQTDAQSMFLQGERTDENKIPTDQNVVYRGSWYGHIANGTSWSGNASDKEGGNRAEFTVNFGEKKINGTLTAENRQAATFTIEGDIKDNGFEGTAKTADLGFDLDQSNTTGTPKAYITNAKVQGGFYGPKADELGGWFAYPGDNQAQPSASGSGASAANSATVVFGAKR

SEQ ID NO: 179 - protein, 340 aa, Neisseria meningitidis
TQDKPRNGAVASGGAGAAASNGAAGTSSENSKLTTVLDAVELTLNDKKIKNLDNFSNAAQLVVDGIMIPLLPEASESGKNQANQGTNGGTAFTRKFNHTPKSDEKDTQAGTAENGNPAASNTAGDANGKTKTYEVEVCCSNLNYLKYGMLTRKNSKSAMQAGESSSQADAKTEQVGQSMFLQGERTDEKEIPNDQNVVYRGSWYGHIANGTSWSGNASDKEGGNRADFTVNFGTKKINGTLTADNRQAATFTIVGDIEGNGFSGTAKTADSGFDLDQSNNTRTPKAYITNAKVQGGFYGPKAEELGGWFAYSDDKQTKNATDASGNGNSASSATVVFGAK

SEQ ID NO: 180 - protein, 330 aa, Neisseria meningitidis
TQDKPGNGAAASGGTGAAASGGAADMPSENSKLTTVLDAVELTHGGTAIKNLDNFSNAAQLVVDGIMIPLLPEASESGHNQANQGTNGGTAFTRKFNHTPTSDEKDTQAGTAANGNQAASNTAGDANGKTKTYAVEVCCSNLNYLKYGLLTRKTAGNTGEGGNGSQTAAQTDAQSMFLQGERTDENKIPTDQNVVYRGSWYGHIANGTSWSGNASDKEGGNRAEFTVNFGEKKINGTLTAENRQAATFTIEGDIKDNGFEGTAKTADLGFDLDQSNTTGTPKAYITNAKVQGGFYGPKADELGGWFAYPGDNQAQPSASGSGASAANSAT

SEQ ID NO: 181 - protein, 340 aa, Neisseria meningitidis
TKDKAESGNGNGNGTSGGASVSASNGAAGTSSENSKLTTVLDAVELKSGDKEVKKLDNFSNAAQLVVDGIMIPLLPEASESGSNQANQGTNGGTAFTRKFNHTPKSDEKDTQAGTAENGNPAASNTAGDANGKTKTYEVEVCCSNLNYLKYGMLTRKNSKSAMQAGESSSQADAKTEQVEQSMFLQGERTDEKEIPNDQNVVYRGSWYGHIANGTSWSGNASDKEGGNRADFTVNFGTKKINGTLTADNRQAATFTIVGDIEGNGFSGTAKTADSGFDLDQSNNTRTPKAYITNAKVQGGFYGPKAEELGGWFAYSDDKQTKNATDASGNGNSASSATVV

SEQ ID NO: 182 - protein, 330 aa, Neisseria meningitidis
TKDKPGNGAAAPGGTDAAASNGAAGTSSENSKLTTVLDAVELKSGGKEVKNLDNFSNAAQLVVDGIMIPLLPKDSESGNTQADKGKNGGTEFTRKFEHTPESDKKDAQAGTAENGNPAASNTAGDTNGKTKTYAVEVCCSNLNYLKYGLLTRKTAGNTGEGGNGAAQTDAQSMFLQGERTDEKEIPNDQNIVYRGSWYGHIANGTSWSGNASDKEGGNRAEFTVNFADKKLNGTLTAGERTSPTFTITATIQGNGFEGTAKTGDDGFALDTKNTVDTHKAHITDANVQGGFYGPKAEELGGWFAYPGDRQAQPSASGSGTSAANSATVVF

SEQ ID NO: 183 - protein, 320 aa, Neisseria meningitidis
TKDKPANGNTAAASGGTDAAASGGTAGTPSESTKLTTVLDAVELKSGDKEVKKLDNFSNAAQLVVDGIMIPLLPEASESGNNQANQGTNGGTAFTRKFNHTPKSDEKDTQAGTAENGNPAASNTAGDANGKTKTYEVEVCCSNLNYLKYGLLTRKTAGNTGEGGNGSPTAAQTDAQSMFLQGERTDEKEIPKEQQDIVYRGSWYGHIANGTSWSGNASDKEGGNRAEFTVNFGDKKITGTLTADNRQAATFTIEGDIEGNGFSGTAKTDNLGFDLDQSDNTRTPKAYITDAKVQGGFYGPKAEELGGWFAYPGDKQTEKA

SEQ ID NO: 184 - protein, 350 aa, Neisseria meningitidis
TQDKAANGNTAAASGGTDAAASNGAAGTSSENSKLTTVLDAVELTLNDKKIKNLDNFSNAAQLVVDGIMIPLLPETSESGSNQADKGKKGKNGKNGGTDFTYKTTYTPKNDDKDTKAQTGAAGSSGAQTDLGKADVNGGKAETKTYEVEVCCSNLNYLKYGMLTRKNSKSAMQAGGNSSQADAKTEQVEQSMFLQGERTDEKEIPNDQNVVYRGSWYGHIASSTSWSGNASNATSGNRAEFTVNFDTKKINGTLTAENRQEATFTIDGKIEGNGFSGTAKTADLGFDLDQSNTTGTPKAYITDAKVQGGFYGPKAEELGGWFAYPGDKQTEKATVASGDGNSASSATVVF

SEQ ID NO: 185 - protein, 340 aa, Neisseria meningitidis
TKDKPANGNTAAASGGTDAAASNGAAGTSSENGKLTTVLDAVELKLGDKEVQKLDNFSNAAQLVVDGIMIPLLPEASESGNNQANQGTNGGTAFTRKFDHTPESDKKDAQAGTQTNGAQTASNTAGDTNGKTKTYEVEVCCSNLNYLKYGMLTRKNSKSAMQAGESSSQADAKTEQVEQSMFLQGERTDEKEIPSEQNIVYRGSWYGYIANDKSTSWSGNASNATSGNRAEFTVNFADKKITGTLTADNRQEATFTIDGNIKDNGFEGTAKTAESGFDLDQSNTTRTPKAYITDAKVQGGFYGPKAEELGGWFAYPGDKQTKNATNASGNSSATVVFGAK

SEQ ID NO: 186 - protein, 340 aa, Neisseria meningitidis
TKDKPANGNTAAASGGTDAAASNGAAGTSSENGKLTTVLDAVELKLGDKEVQKLDNFSNAAQLVVDGIMIPLLPEASESGNNQANQGTNGGTAFTRKFDHTPESDKKDAQAGTQTNGAQTASNTAGDTNGKTKTYEVEVCCSNLNYLKYGMLTRKNSKSAMQAGESSSQADAKTEQVEQSMFLQGERTDEKEIPSEQNVVYRGSWYGHIANGTSWSGNASDKEGGNRAEFTVDFGAKKINGKLTAENRQAATFTIEGDIEGNGFSGTAKTAESGFDLDQSNTTRTPKAYITDAKVQGGFYGPKAEELGGWFAYPGDKQTKNATNASGNSSATVVFGAKRQ

SEQ ID NO: 187 - protein, 340 aa, Neisseria meningitidis
TKDKAESGKTVAASGGTGAAASGGAADMPSENGKLTTVLDAVELTLNDKKIKNLDNFSNAAQLVVDGIMIPLLPKDSESGNNQANQGTNGGTAFTYKTTYTPKSDEKDTQAGTAANGNQAASNTAGDTNGKTKTYEVEVCCSNLNYLKYGMLTRKNSKSAMQAGENGSQADAKTEQVEQSMFLQGERTDEKEIPKEQQDIVYRGSWYGHIAGSTSWSGNASNATSGNRAEFTVNFDTKKINGKLTAENRQAATFTIVGDIKDNGFEGTAKTDNLGFDLDQSNTTGTPKAYITNAKVQGGFYGPKAEELGGWFAYSDDKQTKNATDASGNGNSASSATVVF

SEQ ID NO: 188 - protein, 330 aa, Neisseria meningitidis
TKDKNANGNTPAASSGAGAATMPSETRLTTVLDAVELKSGGKEVQKLDNFSNAAQLVVDGIMIPLLPEASESGKNQADKGKNGGTAFTYTITYTPESDKKDTQAGTPTNGAQTASNTAGDTNGKTKTYEVEVCCSNLNYLKYGMLTRKNSKSAMQAGESSSQADAKTEQVEQSMFLQGERTDEKEIPSEQNIVYRGSWYGYIANDKSTSWSGNASNATSGNRAEFTVNFADKKITGTLTADNRQEATFTIDGNIKDNGFEGTAKTAESGFDLDQSNTTRTPKAYITDAKVQGGFYGPKAEELGGWFAYPGDKQTKNATNASGNSSATVVF

SEQ ID NO: 189 - protein, 340 aa, Neisseria meningitidis
TKDKLENGAAASGSTGAAASGGAADMPSENGKLTTVLDAVELKSGGKEVKNLDNFSNAAQLVVDGIMIPLLPKESESESNQADKGKNGGTAFTRKFEHTPESDKKDTQAGTAENGNPAASNTAGDTNGKTKTYEVEVCCSNLNYLKYGMLTRKNSKSAMQAGENGSQADAKTEQVEQSMFLQGERTDEKEIPKEQQDIVYRGSWYGHIANDTSWSGNASDREGGNRADFTVNFGTKKINGTLTAENRQEATFTIVGDIKDNGFEGTAKTADSGFDLDQSNTTRTPKAYITDAKVKGGFYGPKAEELGGWFAYPGDKQTEKATVTSGDGNSASSATVVFGA

SEQ ID NO: 190 - protein, 340 aa, Neisseria meningitidis
TQDKAANGNTAAASGDASVSASNGAAGTSSENGKLTTVLDAVELTLNDKKIKNLDNFSNAAQLVVDGIMIPLLPETSESGNNQADKGKNGGTAFTRKFDHTPKSDEKDTQAGTAANGAQTASGTAGDTSGKTKTYQVEVCCSNLNYLKYGMLTRKNSESAMQAGESSSQTPAAQTAQGAQSMFLQGERTDENKIPTDQNVVYRGSWYGHIASSTSWSGNASNATSGNRAEFTVNFDTKKITGKLTAENRQEATFTIDGKIEGNGFEGTAKTAELGFDLDQSNTTGTPKAYITNAKVQGGFYGPKAEELGGWFAYPGDKQTENTTVASGNGNSASSATVVF

SEQ ID NO: 191 - protein, 340 aa, Neisseria meningitidis
TKDKPANGNTAEASGGTGAAASDGAAGTSSKNGKLTTVLDAVELKLGDKEVQKLDNFSNAAQLVVDGIMIPLLPEASESGNTNQGTNGGTAFTRKFEQMPESDEKDTKAQTGTGGTQTASNTAGDTNGKTKTYEVEVCCSNLNYLKYGMLTRKNSKSAMQAGESSSQADAKTEQVGQSMFLQGERTDEKEIPNDQNVVYRGSWYGHIANGTSWSGNASDKEGGNRADFTVNFGTKKINGTLTADNRQAATFTIVGDIEGNGFSGTAKTADSGFDLDQSNNTRTPKAYITNAKVQGGFYGPKAEELGGWFAYSDDKQTKNATDASGNGNSASSATVVFGAK

SEQ ID NO: 192 - protein, 340 aa, Neisseria meningitidis; identical to SEQ ID NO: 179

SEQ ID NO: 193 - protein, 340 aa, Neisseria meningitidis
TKDKPANGNTAEASGGTDAAASGGAAGTSSENSKLTTVLDAVELTHGGTAIKNLDNFSNAAQLVVDGIMIPLLPQNSTGKNNQPDQGKNGGTAFIYKTTYTPKNDDKDTKAQTVTGGTQTASNTAGDANGKTKTYEVEVCCSNLNYLKYGLLTRKTAGNTVGSGNSSPTAAAQTDAQSMFLQGERTDENKIPSEQNVVYRGSWYGHIASSTSWSGNASDKEGGNRAEFTVNFGEKKITGTLTAENRQEATFTIDGKIEGNGFSGTAKTAELGFDLDQKNTTRTPKAYITDAKVKGGFYGPKAEELGGWFAYSDDKQTKNATDASGNGNSASSATVVFGAK

SEQ ID NO: 194 - protein, 340 aa, Neisseria meningitidis
TKDKTENGAAASGGAGAAASGGAAAMPSENGKLTTVLDAVELTHGGTAIKNLDNFSNAAQLVVDGIMIPLLPEASESGHNQANQGTNGGTAFTRKFDHTPESDKKDAQAGTQTNGAQTASNTAGDTNGKTKTYEVEVCCSNLNYLKYGMLTRKNSKSAMQAGENGSQADAKTEQVEQSMFLQGERTDEKEIPKEQQDIVYRGSWYGHIANDTSWSGNASDREGGNRADFTVNFGTKKINGTLTAENRQEATFTIVGDIKDNGFEGTAKTADSGFDLDQSNTTRTPKAYITDAKVKGGFYGPKAEELGGWFAYPGDKQTEKATVTSGDGNSASSATVVFGA

SEQ ID NO: 195 - protein, 340 aa, Neisseria meningitidis
TKDKPRNGAVASGGAGAAASNGAAGTSSENSKLTTVLDAVELTLNDKKIKNLDNFSNAAQLVVDGIMIPLLPQNSTGENNQPDQGKTGGTAFIYKTTYTPKNDDKDTKAQTGAAGSSGAQTASGTESVTGGQAGTKTYEVEVCCSNLNYLKYGLLTRKTASNTGEGGNGSQTAAQTAQGAQSMFLQGERTDEKEIPNDQNVVYRGSWYGYIANDTSWSGNASDKEGGNRAEFTVNFGEKKINGKLTAENRQEATFTIEGMIQGNGFEGTAKTADLGFDLDQSNTTGTPKAYITNAKVQGGFYGPKAEELGGWFAYPGDKQTENTTVASGNGNSASSATVV

SEQ ID NO: 196 - protein, 620 aa, Haemophilus influenzae
CSGGGSFDVDNVSNTPSSKPRYQDDTSSSRTKSKLEKLSIPSLGGGMKLVALNLFDRNKPSLLNEDSYMIFSSRSTIEEDVKNNNQNGEHPIDSIVDPRAPNSNENRHGQKYVYSGLYYIQSWSLRDLPNKKFYSGYYGYAYYFGNTTASALPVGGVATYKGTWSFITAAENGKNYELLRNSGGGQAYSRRSATPEDIDLDRKTGLTSEFTVNFGTKKLTGGLYYNLRETDANKSQNRTHKLYDLEADVHSNRFRGKVKPTKKESSEEHPFTSEGTLEGGFYGPEGQELGGKFLAHDKKVFGVFSAKEQQETSENKKLPKETLIDGKLTTFKTTNATANATTDATTSTTASTKTDTTTNATANTENFTTKDIPSFGEADYLLIDNYPVPLFPESGDFISSKHHTVGKKTYQVEACCSNLSYVKFGMYYEAPPKEEEKEKDKDKDKDKEKEKQATTSIKTYYQFLLGLRTPSSEIPKEGSAKYHGNWFGYISDGETSYSASGDKERSKNAVAEFNVNFAEKTLTGELKRHDTQNPVFKINATFQSGKNDFTGTATAKDLAIDGKNTQGTSKVNFTATVNGAFYGPHATELGGYFTYNGNNPTDKNSSSNSEKARAAVVLEL

SEQ ID NO: 197 - protein, 630 aa, Haemophilus influenzae
CSGGGGSFDVDDVSNPSSSKPRYQDDTSSSRTKSKLENLSIPSLGGGMKLVAQNLRDRTKPSLLNEDDYMIFSSLSTIKADVEKENKHYTSPVGSIDEPSTTNPKENDHGQRYVYSGLYYIPSWNLNDLKNNKYYYSGYYGYAYYFGKQTATTLPVNGKVTYKGTWSFITAAENGKRYPLLSNGSQAYFRRSAIPEDIDLEVKNDENREKGLVSEFSADFGTKKLTGGLFYTKRQTHIQNHEKKKLYDIDAHIYSNRFRGKVNPTQKDSKEHPFTSEGTLEGGFYGPEGQELGGKFLAGDKKVFGVFSAKGTEENKKLPKETLIDGKLTTFSTKTTDAKTNATANATTSTAANTTTDTTANTITDAENFKTKDISSFGEADYLLIDNYPVPLLPESGDFISSKHHTVGKKTYQVKACCSNLSYVKFGMYYEVPPKEEEKDKEKKEKEKEKQATNLSNTYYQFLLGLRTPSSEIPKGGSAKYLGSWFGYLSDGSTSYSPSGDKKRENNALAEFNVNFVDKTLKGQLIRHDNQNTVFTIDATFKGGKNNFTGTATANNVAIDPQSTQGTSNVNFTATVNGAFYGPNATELGGYFTYNGNPTDKSSSTVPSSSNSKNARAAVVFGARQQVETT

SEQ ID NO: 198 - protein, 599 aa, Haemophilus influenzae
CSGGGGSFDVDDVSNPSSSKPRYQDDTSNQRKKSNLEKLSIPSLGGGMKLVAQNLRGREPSLLNEDGYIIFSSLSKIEDDFKKENQSQEPTIGSIDEPSETNSPQNHHGQQYVYSGLYYIQSWRNFSNGKFYSGYYGYAYYFGKQTATTLPVNGEATYKGTWSFITATERGKNYSLFSNSSGQGYSRRSAISEDIDLENDQNNGETGLISQFSADFGTKKLKGELFYTKRKTNNQNYEKKKLYDIDANIYSNRFRGKVKPTEKDSEEHPFTREGTLEGGFYGPNGEELGGKLAGDKKVFGVFSAKETEETKQKTLPKETLIDGKLTTFSTKKPDATTSTTANAKTDATTNAENFTTKDISSFGEADYLLIDNYPVPLLPETENSGDFATSKHYEVRDKTYKVEACCKNLSYVKFGMYYEDNKKNNKNETEQYHQFLLGLRTASSKIPTTGNVKYRGSWFGYISDGETSYSTTGDKRQDKNAVAEFDVNFAEKTLKGSLKRADSQNPVFSIEANFKNGGNAFTGTATAKDLVIDGKNSQTKNTPINITTKVNGAFYGPNASELGGYFTYNGKNPTDKNSPTASSPSNSEKARAAVVFGAK

SEQ ID NO: 199 - protein, 630 aa, Haemophilus influenzae
CSGGGGSFDVDDVSNPSSSKPRYQDDTSSSRKKSDLEKLSIPSLGGGMKLVAQNLRGSEPSLLNEDGYMIFSSLSTIEEDVKKVKKEKNVDTNPIGSIDEPSASATNPPQNHHGQKYVYSGLYYIPSWNLIDSTKNKYYFGYYGYAYYFGKETATTLPVNGKVTYKGTWSFITATEKGKRYELFRRLGSPYYRRSAISEDIDDIENHPSNGDAGLISEFSVDFGEKKLTGELYYNKRKTNVNPSANTKHTLYNLEAKVYSNRFRGNVTPKEPDSKDHPFTSKGTLEGGFYGPKGEELGGKFLAGDKKVFGVFSAKETQKTKIIQRNLIDGKLTTFSTKTTNGTTITTTTNAITDATANTKTDATANTKTDAKTDAKTDAENFTTKDISSFGEADYLLIDKYPIPLLPEKNTDDFISSRHHDVGGKTYKVEACCKNLSYVKFGMYYEDKEKKNTNQTGQYHQFLLGLRTPSSQIPVTGNVKYLGSWFGYIGDDKTSYSTTGNKQQDKNAPAEFDVNFDNKTLTGKLKRADSQNTVFNIEATFKNGSNAFEGKATANVVIDPKNTQATSKVNFTTTVNGAFYGPHATELGGYFTYNGNNPTATNSESSSTVPSPPNSPNARAAVVFGAKRQV

SEQ ID NO: 200 - protein, 610 aa, Haemophilus influenzae
CSGGGGSFDVDDVSNPSSSKPRYQDDTLNQRKKSNLQKLSIPSLGGGMKLVAQNFAGAKEPSFLNENDYISYFSSLSTIKDDVENNNKNKDTPIGSIDEPRAPNSNENHQNHHGQQYVYSGLYYIPSWRLINLPNKFYSGYYGYAYYFGKQTATTLPVDGVATYKGTWSFITATERGKNYSLFNNRGQAYSRRSATPGDIDLENGDAGLTSEFTVNFGTKKLTGELYYNERETNLNQSKDRKHKLYDLEADVYSNRFRGTVKPTKKESSEEHPFTSEGTLEGGFYGPNGEELGGKFLAGDNRVFGVFSAKEQQETEENKKLLKETLIDGKLTTFSTKKTDTTTSTTTNTAASTTTDEKTNAKNFTTEDISSFGEADYLLIDNYPVPLLPETENSGDFISSRHHDVGGGKTYKVEACCKNLSYVKFGIYYEDNEKNNKNETEQYHQFLLGLRTPSSQIPATGNVKYRGSWFGYISDGKTSYSTTGDKQQDKNALAEFDVNFDTKTLTGELKRAGTQNTVFTIDATFKSGENNFTGTATANNVAIDSQNTQGTPKVNFKTTVNGAFYGPNASELGGYFTYNGKNPTATNSESSSTVPSPPNSPNARAAVVFG

SEQ ID NO: 201 - protein, 630 aa, Haemophilus influenzae
CSGGGGSFDVDDVSNPSSSKPRYQDDTSNQRTKSNLQNLSIPSLGGGMKLVAQNLLGKREPSFLNEDGYMIFSSRSTIKDDVEKVKNKNGGGGLIGSIEEPNGTPQNSNSQKYVYSGLYYIENWKDFSQLQAPEKKAYTGHYGYAYYFGNQTATTLPVNGEATYKGTWNFITATRYNKNYPLFGSGSGAYSKRSAISEDIDNLENNSTNGDKGLTSEFTVNFGTKKLTGGLYYNERETHRNQSQDRKHKLYDLEADVHSNRFRGKAKPTEKNSTDHPFTSEGTLEGGFYGPKGEELGGKFLADDNRVFGVFSAKETEETEKKNLSKETLIDGKLITFSTKKTDATANATTNTTTDVKNNATTDTTANAENFTTKDISSFGEADYLLIDNYPVPLLPENTNDFISSKHHEVGGKRYKVEACCKNLSYVKFGMYYEDKENNKNETDKEKEKQTTTSIKTYYQFLLGLRTPSSEIPKMGNVTYRGSWFGYIGDDKTSYSATGDKRQDKNAPAEFNVDFNNKKLTGTLKRHDNQNPVFKINATFQNGRNDFEGTATAENFVIDGKDSQGNTPINITTKVNGAFYGPNATELGGYFTYNGNPTATNSESSSTVPSPPNSPNARAAVVFGAKKQVE

SEQ ID NO: 202 - protein, 620 aa, Haemophilus influenzae
CSGGGGSFDVDDVSNPSSSKPRYQDDTSNQRKKSDLQKLSIPSLGGGMKLVAQNFIGAKEPSFLNENGYMIFSSLSTIKDDVENVKNNNQNGGSLIGSIEEPNGTSQDSNSQQYVYSGLYYIDSWRDHKKQENKAYAGYYGYAFYYGNKTATDLPVKGIAKYKGTWNFITATENGKRYSLFSNNSQAYSRRSATRGDIDLENDPKNEREKGLVSEFSVDFDKKELTGGLYYNERETDRNKSKDRKHKLYNLKAKVYSNRFRGNVIPEEPTSTDHPFTSDGTLEGGFYGPNGEELGGKFLAGDNRVFGVFSAKENPENKTLSRETLIDGKLITFSTKKTDAKTNATTSTAANTTTDTTANTITDEKNFKTEDISSFGEADYLLIDKYPIPLLPDKNTNDFISSKHHTVGNKRYKVEACCSNLSYVKFGMYYEAPPKEEEKEKEKDKEKKEKQTTTTSINTYYQFLLGHRTPKDDIPKTGSAQYRGNWFGYIGDDKTSYSATGGKNAVAEFDVNFADKTLKGVLKRHDTQNPVFNIEADFKNGRNDFTGKATANVVIDPQNTQATSKVNFTATVNGAFYGPNATELGGYFTYNGNPTDKSSSTVPSPPNSPNARAAVVFGAK

SEQ ID NO: 203 - protein, 610 aa, Haemophilus influenzae
CSGGGGSFDVDDVSNPSSSKPRYQDDTSSSRTKSKLENLSIPSLGGGMKLVAQNLRGNKEPSLLNEDGYIPYFSSLSTIKADVEKENKHGTSPVGSIDEPSTTNPPEKHHGQKYVYSGLYYIQSWNNLSNGKFYSGYYGYAFYYGNKTATNLPVSGVAKYKGTWNFITATENGKTYSLLRNNGGQAYAKRSAIPEDIDLDSKTGLISEFSVDFGTKKLTGELYYNKRKTNLINESQDRKHKLYTLEADVHSNRFRGKAKPPEKDSSDHPFTSEGTLEGGFYGPDGEELGGKFLAGDKKVFGVFSAKETEETPEKKLSRETLIDGKLITFKRTDATTNATASTTTNTAANTAANTKTNEKNFTTEDISSFGEADYLLIDNYPIPLFPENTSDFATSKHHNIGNKTYKVEACCKNLSYVKFGIYYEDKPIKEEEKDKEKQTTATTNTYYQFLLGHRTANAEIPKKGSAKYHGSWFGYITDGKTSYSTTGAKQRDNSGVSDFDVNFDNKKLTGTLKRHDTGNTVFSIEANLKNGGNDFTGTATANNVAIDSQNTQANTSRVNFTATVKGAFYGPNASELGGYFTYNGKNPTDKNSSAVSSSSNSENARAAVVL

SEQ ID NO: 204 - protein, 640 aa, Haemophilus influenzae
CSGGGSFDVDNVSNTPSSKPRYQDDTSNQRKKSNLKKLFIPSLGGGMKLVAQNLRGNKEPSFLNEDDYISYFSSLSTIEKDVKDNNKNGADLIGSIDEPSTTNPPEKHHGQKYVYSGLYYTPSWSLNDSKNKFYLGYYGYAFYYGNKTATNLPVNGVAKYKGTWDFITATKNGKRYPLLSNGSHAYYRRSAIPEDIDLENDSKNGDIGLISEFSADFGTKKLTGQLSYTKRKTNNQPYEKKKLYDIDADIYSNRFRGTVKPTEKDSEEHPFTSEGTLEGGFYGPNAEELGGKFLATDNRVFGVFSAKETEETKKEALSKETLIDGKLITFSTKKTDAKTNATTSTAANTTTDTTANTITDEKNFKTEDISSFGEADYLLIDKYPIPLLPDKNTNDFISSKHHTVGNKRYKVEACCSNLSYVKFGMYYEDPLKEKETETETETEKDKEKEKEKDKDKEKQTAATTNTYYQFLLGHRTPKDDIPKTGSAKYHGSWFGYITDGKTSYSPSGDKKRDKNAVAEFNVDFAEKKLTGELKRHDTGNPVFSIEANFNNSSNAFTGTATATNFVIDGKNSQNKNTPINITTKVNGAFYGPKASELGGYFTYNGNSTATNSESSSTVSSSSNSKNARAAVVFGARQQVE

SEQ ID NO: 205 - protein, 91 aa, Artificial Sequence
  Synthetic
ETKRPAAKPKAQKKKRKKKKTGVKSVKKGKKKIKKKKGTKKAAVKKKGSKKKAVKGKKKAKKPKKKSPTKKGGSGSKGILPAPKAPKGRNI

SEQ ID NO: 206 - protein, 519 aa, Mannheimia haemolytica
TVSASETEALLQPGFGFSAKIPRRNLLPQGKEDVAPIGDIKEITGDLPKIPYEEEVKACGSSADGFSHTHDRNHKLYTRDFNFVRSGYVVHSGPKPEIKPKEILRTGAHGYVYYLGIEPPKAIPTQKLTYKGYWDFTTYAAKGRDSNIFLIPAGINSGAIPENSHDINVDDSEKPMGHTGEFTADFANKTLTGTLVRNGYVSRSKEQKITTIYDIDAKIKGNRFSGKANPKKPMILIFGKSSTTLEGGFFGGEAQELAGKFLADDKSVFVVFAGTRDAKKDDSESAFDAFPIKLKDLNKSEMDTFGNATHLIINNKQIPLIAEATKSFAEMKFDTYRVSVCCNNLDYVKFGIYSEGNNSDTALQEYLVGERTALADLPTGTVKYRGTWDGVMYSKSGSAGVESPSNSESGTRSLFDVDFVNKKINGKLIANDGVEERPMLTLEGNLKGNGFGGTAKTGNSGFNLDPKSTNGGTVGHINTQFEGGFYGPKATELGGIVQNTETDKDRVSITFGGKRQIEK

SEQ ID NO: 207 - protein, 688 aa, Neisseria gonorrhoeae
CLGGGGSFDLDSVDTEAPRPAPKYQDVPSKKPEARKDQGGYGFAMRFKRRNWHPSANPKEDEVKLKNDDWEATGLPTEPKKLPLKQQSVISEVETNGNSKMYTSPYLSQDADSSHANGANQPKNEVTDYKKFKYVYSGWFYKHAKSEVKNENGLVSAKRGDDGYIFYHGDKPSRQLPASEAVTYKGVWHFVTDTKQGQKFNDILETSKGQGDKYSGFSGDEGETTSNRTDSNLNDKHEGYGFTSNFKVDFNNKKLTGKLIRNNKVINTAASDGYTTEYYSLDATLRGNRFSGKAIATDKPNTGGTKLHPFVFDSSSLSGGFFGPQGEELGFRFLSDDGKVAVVGSAKTKDSTANGNAPAASSGPGAATMPSETRLTTVLDAVELTPDGKEIKNLDNFSNATRLVVDGIMIPLLPTESGNGQADKGKNGGTDFTYETTYTPESDKKDTKAQTGAGGMQTASGTAGVNGGQVGTKTYKVQVCCSNLNYLKYGLLTRENNNSVMQAVKNSSQADAKTKQIEQSMFLQGERTDENKIPQEQGIVYLGFWYGRIANGTSWSGKASNATDGNRAKFTVNFDRKEITGTLTAENRSEATFTIDAMIEGNGFKGTAKTGNDGFAPDQNNSTVTHKVHIANAEVQGGFYGPNAEELGGWFAYPGNEQTKNATVESGNGNSASSATVVFGAKRQKLVK

SEQ ID NO: 208 - protein, 683 aa, Neisseria gonorrhoeae
CLGGGGSFDLDSVDTEAPRPAPKYQDVPSKKPEARKDQGGYGFAMRFKRRNWYPPSNPKENEIRLSEGDWEQTGNGNIKNPSKQKNIIDALSGNGEAPLQDSSQQGEGISKVTDYHDFKYVWSGFFYKQIGNTIKKDDSSSKIIEARNGPDGYIFYKGTDPSRKLPVSGSVEYKGTWDFLTDVQANQKFTDLGSAFTKSGDRYSAFSGELDYIVRKEEDKKDGHVGLGLTTEITVNFEKKTLSGKLIKNNMVINNGDEPTTQYYSLEAQVTGNRFNGKAMVTDKPENSKSKQHPFVSDSSSLSGGFFGPQGEELGFRFLSNDNKVAVVGSAKTKDETASSGGTSGGASVSASNGATGTSSGNSNLTTVLDAVELTPDGKEIKDLDNFSNAAQLVVDGIMIPLLSTESGNGQADKGKNGGTDFTYTTTYMPESDKKDTKAQTGAGGMQTASDAAGVNGGQAGTKTYKVEACCSNLNYLKYGLLTRENSNSVMQTVRNSSQAAARTAQGAQSMFLQGERTDEKEIPKEQKVVYLGTWYGHIAANGTSWTGNASDQQSGNRAKFDVNFKDKKITGTLTAANRQEATFTIDAMIDDNGFKGTAKTGNDGFAPDQNSSTGTYKVHIANAEVQGGFYGPNAEELGGWFAYPGNGQTKNAQENAQASSGNGNSAVSATVVFGAKRQQLVK

SEQ ID NO: 209 - protein, 679 aa, Neisseria gonorrhoeae
CLGGGGSFDLDSVDTEAPRAAPKYQDVPSKKPEARKDQGGYGFAMRFKRRNWYSQANLKEDKIPLSEGDWEQTDNGNIKNPSKQKNIINALSGNEEASLQDSSVQGEGISKVKDHHNFQYVWSGFFYKQISSTIKRDDSSNKIIEVRNGPDGYIFYKGKDPSRKLPASNEVTYKGTWDFLTDVKANQKFTDLANTFARPGDRYSAFSGELDYIVKKQEDKKEKHKGLGLTTEITVDFGKKTLSGKLIKNNHVINDNSDDQNKYTTEYYTLDATLRGNRFSGKAMATDKSSDGQAKQHPFVSNSSSLSGGFFGPQGKELGFRFLSDDNKVAVVGSAKTKDEATNGNTAAASSGPGAATMPSETRLTTVLDAVELTPDGKEIKDLDNFSDATRLVVDGIMIPLLPKDSESGVSQPDKGENGGTDFTYTTTYMPESDKKDTKAQTGAGGMQTASGAAGVNSGQAGTKTYKVEACCSNLNYLKYGMLTRKNSESAMQAGGSSNQADAKTEQAEQSMFLQGERTDEKQIPKDENVVYLGSWYGRIANGTSWSGNASNTTSGNKAEFTVNFDKKEITGMLTAANRPEATFTIDAMIDGNGFKGTAKTGNDGFAPDQNNSTVTHKVHIAEAKVRGGFYGPNAEELGGWFAYPGNGQAKNAQTSSGDGNSAGSATVVFGAKRQELVQ

SEQ ID NO: 210 - protein, 679 aa, Neisseria gonorrhoeae
CLGGGGSFDLDSVDTEAPRPAPKYQDVPSKKPEARKDQGGYGFAMRFKRRNWYPPSNPKENEIRLSEGDWEQTDNGNIKNPSKQKNIINALSGNGGASLQDSSQQGEGISKVTDHHDFKYVWSGFFYKQIGNTVKKSGLSITEARNGPDGYIFYKGKDPSRELPVLGSVEYKGTWDFLTDVRVNQKFTDLGSAYTRSGDRYSAFSGELDYIVKKEDDKKEKHKGLGLTTEITVDFEKKTLNGKLIKNNHVIGNVATENKYTTEYYTLDATLRGNRFSGTATATDKSSDGQAKQHPFVSDSSSLSGGFFGPKGEELGFRFLSDDQKVAVVGSAKTRDKAENGGGNGASGGASVSASNGAAGMPSENGKLTTVLDAVELESDGKKVKNLDNFSDATRLVVDGIMIPLLPTESGNGQADKGKNGGTDFTYTTTYTPESDKEDTQTGMAANGVQTVSNAAGGTSGKTKTHYEVQACCSNLNYLKYGLLTRKTAGNTGGGGNGSQAVQTAQGAQSMFLQGERTDEKEIPKDGNVVYLGTWYGHIAINGTSWTREASNQENGNRAKFDVNFKDKKITGTLTAANRQEATFTIDAMIEGNGFKGTAKTGDGGFAPDQNNSTGTHKVHIAEAKVQGGFYGPNAEELGGWFAYPGNGQAENAQTSSGNGNSAGSATVVFGAKRQELVK

SEQ ID NO: 211 - protein, 673 aa, Neisseria gonorrhoeae
CLGGGGSFDLDSVDTEAPRPAPKYKDVPSKKPEARKDQGGYGFAMRFKRRNWYPPSNPKENEIRLSEGNWEQTDDGEIKTPSKQKNIINALSGNEGVSLQDSSQQGEGISKVTDHHDFKYVWSGFFYKRIGITTKKDDLSNKIIEARNGPDGYIFYKGTDPSRKLPVSGSVEYKGTWDFLTDVKANQKFTGLGNTSTKSGDRYSAFSGELDYIVKKESDKKDGHVGLGLTTEITVDFGKKTLSGKLIKNNMVINNGDEPTTQYYSLEAQVTGNRFNGKAIATDKPKVNETKEHPFVSDSSSLSGGFFGPQGEELGFRFLSHDNKVAVVGSAKTKDKNANGNTAAAGTAGAAGMSSEDTKLTTVLDAVELTPDGKKVKNLDNFSDATQLVVDGIMIPLLPTESGNGQADKGENGKTAFIYETTYTPESDKKDTQTGMATNGVQTVSNTAGGTSGKTKTHYKVQACCSNLNYLKYGLLTRENSNSVMQTVRNSSQAAARTEQGAQSMFLQGERTDEKEIPKEQKVVYLGTWYGHIAANGTSWTGKASDQQSGNRAKFDVNFKDKKITGTLTAANRQAETFTISGMIDGNGFEGTAKTGNGGFALDANNTAATHKAHIAEAKVRGGFYGPNAEELGGWFAYPGNGQAKNAQASSGNENSAGSATVVFGAKRQQLVQ

SEQ ID NO: 212 - protein, 682 aa, Neisseria gonorrhoeae
CLGGGGSFDLDSVDTEAPRAAPKYQDVPSKKPEARKDQGGYGFAMRFKRRNWYPPANPKEEKIPLSENDWEQTDNGNIKNPSKQKNIINALSGNGGASLQDSSQQGEGISKVTDHHDFKYVWSGFFYKQIGNTIKRDDSSSKVIEARNGPDGYIFYKGTDPSRKLPVSGSVEYKGTWDFLTDVQANQKFTDLGSAFTKSGDRYSAFSGELDYIVRKEEDKKDKHVGLGLTTEITVDFEKKTLNGKLIKNNMVINNKDEYTTQYYSLDATLRGNRFSGKAMATDKSKNGETGDQTKQHPFVSDSSSLSGGFFGPKGEELGFRFLSDDGKVAVVGSAKTKDKAENGGGNGDSGGASVSASGGTTGTPSENGKLTTVLDAVELTPNGKEIKNLDNFSNAAQLVVDGIMIPLLPTESGNGQADKGENGKTAFIYETTYTPESDEKDTQTGMAANGVQTVSNAAGGTSGKTKTHYEVQACCSNLNYLKYGLLTRKTADNTGGGGKGSQAAAQTAQGAQSMFLQGERTDEKQIPKDENVVYLGSWYGYIANGTSWSGNASNTTSGNKAEFTVNFDKKKITGMLTAANRQEATFTIDAMIESNGFKGMAKTGNGGFAPDQNSSTGTHKVHITSAAVQGGFYGPKAEELGGWFAYPGNGQTKNAQASSGNGNSAGSATVVFGAKRQQLVK

SEQ ID NO: 213 - protein, 341 aa, Neisseria gonorrhoeae
TKDSTANGNAPAASSGPGAATMPSETRLTTVLDAVELTPDGKEIKNLDNFSNATRLVVDGIMIPLLPTESGNGQADKGKNGGTDFTYETTYTPESDKKDTKAQTGAGGMQTASGTAGVNGGQVGTKTYKVQVCCSNLNYLKYGLLTRENNNSVMQAVKNSSQADAKTKQIEQSMFLQGERTDENKIPQEQGIVYLGFWYGRIANGTSWSGKASNATDGNRAKFTVNFDRKEITGTLTAENRSEATFTIDAMIEGNGFKGTAKTGNDGFAPDQNNSTVTHKVHIANAEVQGGFYGPNAEELGGWFAYPGNEQTKNATVESGNGNSASSATVVFGAKRQKLVK

SEQ ID NO: 214 - protein, 301 aa, Neisseria gonorrhoeae
DLDNFSNAAQLVVDGIMIPLLSTESGNGQADKGKNGGTDFTYTTTYMPESDKKDTKAQTGAGGMQTASDAAGVNGGQAGTKTYKVEACCSNLNYLKYGLLTRENSNSVMQTVRNSSQAAARTAQGAQSMFLQGERTDEKEIPKEQKVVYLGTWYGHIAANGTSWTGNASDQQSGNRAKFDVNFKDKKITGTLTAANRQEATFTIDAMIDDNGFKGTAKTGNDGFAPDQNSSTGTYKVHIANAEVQGGFYGPNAEELGGWFAYPGNGQTKNAQENAQASSGNGNSAVSATVVFGAKRQQLVK

SEQ ID NO: 215 - protein, 343 aa, Neisseria gonorrhoeae
TKDEATNGNTAAASSGPGAATMPSETRLTTVLDAVELTPDGKEIKDLDNFSDATRLVVDGIMIPLLPKDSESGVSQPDKGENGGTDFTYTTTYMPESDKKDTKAQTGAGGMQTASGAAGVNSGQAGTKTYKVEACCSNLNYLKYGMLTRKNSESAMQAGGSSNQADAKTEQAEQSMFLQGERTDEKQIPKDENVVYLGSWYGRIANGTSWSGNASNTTSGNKAEFTVNFDKKEITGMLTAANRPEATFTIDAMIDGNGFKGTAKTGNDGFAPDQNNSTVTHKVHIAEAKVRGGFYGPNAEELGGWFAYPGNGQAKNAQTSSGDGNSAGSATVVFGAKRQELVQ

SEQ ID NO: 216 - protein, 346 aa, Neisseria gonorrhoeae
TRDKAENGGGNGASGGASVSASNGAAGMPSENGKLTTVLDAVELESDGKKVKNLDNFSDATRLVVDGIMIPLLPTESGNGQADKGKNGGTDFTYTTTYTPESDKEDTQTGMAANGVQTVSNAAGGTSGKTKTHYEVQACCSNLNYLKYGLLTRKTAGNTGGGGNGSQAVQTAQGAQSMFLQGERTDEKEIPKDGNVVYLGTWYGHIAINGTSWTREASNQENGNRAKFDVNFKDKKITGTLTAANRQEATFTIDAMIEGNGFKGTAKTGDGGFAPDQNNSTGTHKVHIAEAKVQGGFYGPNAEELGGWFAYPGNGQAENAQTSSGNGNSAGSATVVFGAKRQELVK

SEQ ID NO: 217 - protein, 341 aa, Neisseria gonorrhoeae
TKDKNANGNTAAAGTAGAAGMSSEDTKLTTVLDAVELTPDGKKVKNLDNFSDATQLVVDGIMIPLLPTESGNGQADKGENGKTAFIYETTYTPESDKKDTQTGMATNGVQTVSNTAGGTSGKTKTHYKVQACCSNLNYLKYGLLTRENSNSVMQTVRNSSQAAARTEQGAQSMFLQGERTDEKEIPKEQKVVYLGTWYGHIAANGTSWTGKASDQQSGNRAKFDVNFKDKKITGTLTAANRQAETFTISGMIDGNGFEGTAKTGNGGFALDANNTAATHKAHIAEAKVRGGFYGPNAEELGGWFAYPGNGQAKNAQASSGNENSAGSATVVFGAKRQQLVQ

SEQ ID NO: 218 - protein, 346 aa, Neisseria gonorrhoeae
TKDKAENGGGNGDSGGASVSASGGTTGTPSENGKLTTVLDAVELTPNGKEIKNLDNFSNAAQLVVDGIMIPLLPTESGNGQADKGENGKTAFIYETTYTPESDEKDTQTGMAANGVQTVSNAAGGTSGKTKTHYEVQACCSNLNYLKYGLLTRKTADNTGGGGKGSQAAAQTAQGAQSMFLQGERTDEKQIPKDENVVYLGSWYGYIANGTSWSGNASNTTSGNKAEFTVNFDKKKITGMLTAANRQEATFTIDAMIESNGFKGMAKTGNGGFAPDQNSSTGTHKVHITSAAVQGGFYGPKAEELGGWFAYPGNGQTKNAQASSGNGNSAGSATVVFGAKRQQLVK

SEQ ID NO: 219 - protein, 706 aa, Moraxella catarrhalis
MKHIPLTTLCVAISAVLLTACGGSGGSNPPAPTPIPNASGSGNTGNTGNAGGTDNTANAGNTGGTNSGTGSANTPEPKYKDVPTDENKKDEVSGIQEPAMGYGMALSKMNLHKQQDTPLDEKDIITLDGKKQVAKGEKSPLPFSLDVENKLLDGYIAKMNEADKNAIGDRIKKDNKDKSLSKAELAKQIKEDVRKSHEFQQVLSSLKNKIFHSNDGTTKATTRDLQYVDYGYYLVNDGNYLTVKTDELWNLGPVGGVFYNGTTTAKELPTQDAVKYKGHWDFMTDVAKQRNRFSEVKENLQAGRYYGASSKDEYNRLLTDEKNKPERYNGEYGHSSEFTVNFKDKKLTGELFSNLQDSRKGNVTKTKRYDIDANIYGNRFRGSATASDKAEASKTKHPFTSDAKNSLEGGFYGPNAEELAGKFLTNDNKLFGVFGAKRESKAGEKTEAILDAYALGTFNKNNATTFTPFTKKQLDNFGNAKKLVLGSTVIDLVPTGVTKDVNEFTKNKPDSATNKAGETLMVNDKVSVKTYGYGRNFEYLKFGELSVGTSNSVFLQGERTATTGEKAVPTKGTAKYLGNWVGYITGKDSSKSFNEAQDVADFDIDFEKKSVKGKLTTKDRQDPVFNITGDIAGNGWTGKASTTKADAGGYKIDSSSTGKSIVIKDAEVTGGFYGPNANEMGGSFTHNTDDSKASVVFGTKRQEEVK

SEQ ID NO: 220 - protein, 714 aa, Moraxella catarrhalis
MKHIPLTTLCVAISAVLLTACGGSGGSNPPAPTPIPNASGSGNTGNTGNAGGTDNTANAGNTGGASSGTGSANTPEPKYQDVPTDKNEKEQVSPIQEPAMGYGMALSKINLHNRQDTPLDEKNIITLDGKKQVAEGKKSPLPFSLDVENKLLDGYIAKMNEADKNAIGDRIKRENEQNKKISDEELAKKIKENVRKSPDFQKVLSSIKAKTFHSNDGTTKATTRDLQYVDYGYYLVNDADYLTVKTDSPKLWNLGPVGGVFYNGTTTAKELPTQDAVKYKGHWDFMTDVANKRNRFSEVKETPQAGWYYGASSKDEYNRLLTRKDSAPDNYSGEYGHSSEFTVNFKEKKLTGELSSNLQDRHKGDVTKTKRYDIKADIHGNRFRGSAIASDKDDASKAKHPFTSDAKDRLEGGFYGPKGEELAGKFLTDDKKLFGVFGAKRESKAEEKTEAILDAYALGTFNNTNKATTFTPFTKKQLDNFGNAKKLVLGSTVIDLVSTDATKNEFTKEFTKDKPTSATNKAGETLMVNDEVSVKTYGKNFEYLKFGELSVGGSHSVFLQGERTATTGDKAVPTTGTAKYLGNWVGYITGKDTGTGTGKSFTDAQDVADFDIDFGNKSVSGKLITKGRQDPVFNITGQIAGNGWTGKASTAKADAGGYKIDSSSTGKSIVIENAEVTGGFYGPNANEMGGSFTHNADDKVSVVFGTKKQEVKQK

SEQ ID NO: 221 - protein, 709 aa, Moraxella catarrhalis
MKHIPLTTLCVAISAVLLTACGGSSGGFNPPASTPIPNAGNSGNAGNAGNAGGTGGANSGAGNAGGTGGANSGAGSASTPEPKYKDVPTDENKKAEVSGIQEPAMGYGVELKLRNWIPQEQEEHAKINTNDVVKLEGDLKHNPFDNSIWQNIKNSKEVQTVYNQEKQNIEDQIKRENKQRPDKKLDDVALQAYIEKVLDDRLTELAKPIYEKNINYSHDKQNKARTRDLKYVRSGYIYRSGYSNIIPKKIAKTGFDGALFYQGTQTAKQLPVSQVKYKGTWDFMTDAKKGQSFSSFGTSQRLAGDRYSAMSYHEYPSLLTDEKNKPDNYNGEYGHSSEFTVDFSKKSLKGELSSNIQDGHKGSVNKTKRYDIDANIYGNRFRGSATASDTTEASKSKHPFTSDAKNSLEGGFYGPNAEELAGKFLTNDNKLFGVFGAKRESEAKEKTEAILDAYALGTFNKPGTTNPAFTANSKKELDNFGNAKKLVLGSTVIDLVPTGATKDVNEFKEKPKSATNKAGETLMVNDEVIVKTYGYGRNFEYLKFGELSIGGSHSVFLQGERTAEKAVPTEGTAKYLGNWVGYITGKDTGTSTGKSFNEAQDIADFDIDFERKSVKGKLTTQGRQDPVFNITGQIAGNGWTGTASTAKANVGGYKIDSSSTGKSIVIENAKVTGGFYGPNANEMGGSFTHDTDDSKASVVFGTKRQEEVK

SEQ ID NO: 222 - protein, 709 aa, Moraxella catarrhalis
MKHIPLTTLCVAISAVLLTACGGSGGSNPPAPTPIPNASGSGNTGNTGNAGGTDNTANAGNTGGASSGTGSANTPEPKYQDVPTDKNEKEQVSPIQEPAMGYGMALSKINLHNRQDTPLDEKNIITLDGKKQVAEGKKSPLPFSLDVENKLLDGYIAKMDKADKNAIRRRIESENKAKPLSEAELAEKIKEAVRKSYEFQQVMTSLENKIFHSNDGTTKATTRDLQYVDYGYYLANDANYLTVKTDKPKLWNSGPVGGVFYNGSTTAKELPTQDAVKYKGHWDFMTDVANKGNRFSEVKGTRQAGWWYGASSKDEYNRLLTDEKNKPDGYNGEYGHSSEFTVNFKEKKLTGGLFSNLQDSHKQKVTKTKRYDIDANIHGNRFRGSAIASDKEKDSETKHPFTSDAKDRLEGGFYGPKGEELAGKFLTDDNKLFGVFGAKQESKADKTEAILDAYALGAFNKNDANTFTPFTKKQLDNFGNAKKLVLGSTVIDLVPTGAAKDVNEFTKEKPKSATNEAGETLMVNDEVIVKTYGYGKNFEYLKFGELSVGDSHSVFLQGERTATTGEKAVPTKGTAKYLGNWVGYITGKDSSKSFNEAQDVADFDIDFEKKSVKGKLTTKDRTDPVFNITGQIAGNGWTGKASTAKADAGGYKIDSSSTGKSIVIENANVTGGFYGPNANEMGGSFTHNADDSKASVVFGTKRQQEVKQK

SEQ ID NO: 223 - protein, 711 aa, Moraxella catarrhalis
MKHIPLTTLCVAISAVLLTACGGSGGSNPPAPTPIPNASGSGNTGNTGNAGGTDNTANAGNTGGTSSGTGSASTSEPKYQDVPTTPNTKEQVSSIQEPAMGYAMELKLRNAHPHNPNKETEKRIALDQKDLVAVEGNLTNIPFDKNLIEYLKKSPEVVSKFNEQKGGIENNTRLTHKDLSSEQKEAKVKEALDNALTQFAQEKYKELIENAHDKKSDARNRDLKYVKSGFNYLSGYTATDHDKKTNYRGYYGALYYKGSETAKELPQTSAKYKGYWDFMTDATLDNKYTDLPGIARQTQWRSLVSTDEYATLLTDKNNKPSDYNGAYGHSSEFDVNFADKKVTGKLISNQLSGKTVTAKERYKIEADIHGNRFRGSAIASEKTDESKSKHPFTSDAKDRLEGGFYGPKGEELAGKFLTDDNKLFGVFGAKRESKVEKTEAILDAYALGTFNKSGTTNPAFNANSKKELDNFGNINKLVLGSTVIDLTQGNDFVKTIDKEKPATTSNQAGEPLTVNDRVQVQVCCSNLEHLKFGSLSIGGSNSVFLQGERTATTGDKAIPVAGNAKYRGTWAGYVTGSGNTSKGYEAQKFADNANRAEFDVDFAKKSLTGKLIPNTSSDGKSAFDITATIDGNGFSGKANTPDIKTGGLKIDSKNTESGRVIVKDAVVTGGFYGPQANELGGSFTYKSNDAENKDSSAPVVFGARKQQEVKQ

SEQ ID NO: 224 - protein, 583 aa, Mannheimia haemolytica
MFKLKSSFVLLNAALLAACSSNGGSFDVQSAKVESQTQTTPKKPSLQDDNSNARRTVSASETEALLQPGFGFSAKIPRRNLFPQGKEDVAPIGDIKEITGDLTKIPYEEEVKAYGSSADGFSHTHDRNHKLYTRDFNFVRSGYVLHSGAKPEIKPKEILRTGAHGYVYYLGIEPAKAIPTQKATYKGYWDFTTDARKGRDSKYFSNSAGINIGATPENSYDINVDDSEKPMGHTGEFTADFANKTLTGTLVRNGYVSRSKEQKITTIYDIDAKIKGNRFSGKANAKNTDDPYFGKSSTTLEGGFFGGKAQELAGKFLADDKSVFVVFAGKRDAKKDDSESAFDAFKIKLKDLNKSEMDTFGNATHLIINNKQIPLIAEGKKSFAEMKFDDLVTRTIDGKTYRVSVCCNNLDYVKFGTYSEGNNSDTAHQYLVGERTAVADLPTGTVKYRGTWDGVMYSKSGSAGAESPSNSESGTRSLFDVDFVNKKINGKLIANDGVEERPMLTLEGNLKGNGFAGTAKTGNSGFNLDPKSTNGGTVVHINTQFEGGFYGPKATELGGIVHSAETDKDRVSITFGGKRQIEK

SEQ ID NO: 225 - protein, 559 aa, Mannheimia haemolytica
VQSAKVESQTQTTPKKPSLQDDNSNARRTVSASETEALLQPGFGFSAKIPRRNLNPKGKEDVAPIGDITEITGDLTKIPHEEEVKKYGSSDDGFSHTHDGNHKLHTRDFNFVRSGYVLHSGAKPEIIRSDNILRIGAHGYVYYLGIEPAKAIPTQKATYKGYWDFTTDARKGRDNKYFSNSAGINIGAIPENSHDINVDDSTKPMGHTGEFTADFANKTLTGTLVRNGYVSRIKEQKITPIYDIDAKIKGNRFSGKANAKNANDPYFGKSSTTLEGGFFGGEAQELAGKFLADDKSVFVVFAGKRDAKENDSERTFDAFKIKLKDLNKSEMDTFGNATHLIINNKQIPLIAEGKKSFAEMKFDDLVTRTIDGKTYRVSVCCNNLDYVKFGIYSEGNNNNSDTAHQYLVGERTAVADLPTGTVKYRGTWDGVMYSKSGSAGAESPSNSESGTRSLFDVDFVNKKINGKLIANDGVEERPMLTLEGELKGNGFAGTAKTGDSGFNLDPKSTNGGTVVHMNAQFEGGFYGPKATELGGIVHSAETDKDKVSITFGGKRQIEK

SEQ ID NO: 226 - protein, 559 aa, Mannheimia haemolytica
VQSSKAESHTPNVPQKPSLQDDNSNARRTVNSTEAEALLKPGFGFSAKIPRRNLQPFAKGGEEVAPIGDITEITGDITKIPYEEEVKAYGRSDDGFSHTHDGKHKLHTRDFNFVRSGYVLHSGAKPEREAKDIFRIGAHGYVYYLGTEPAKAMPAQKATYNGYWDFTTDARKGKDNKYFNDSAAGINIGATPENRHDVNVDDATKPMGHTGEFTADFTNKTLTGTLVSNGYVSRTTEQEIKPMYYIDAKIKGNRFAGKANAKNPDDPYFGKSSTTLEGGFFGGQAQELAGKFLADDKSIFVVFAGKRDAKENDSESTFDALKINLKDLSKTEMDTFGNATHLIINNQQIPLIAEGKNSFSEMKFDDVVTRTINGKTYRISVCCNNLDYVKFGTYNVENDNDSAHQYLVGERTAVMDLPSGMVQYRGTWNGIIHSKSGPVGAESPSNSESGTRSLFDVDFANKKINGKLIANDGVEERPMLTLEGEVKANGFAGTAKTSDSGFNLDPKSTNGGTVVHINTQFEGGFYGPKATELGGIVHSAETDKDKVSIMFGGKRQIEK

SEQ ID NO: 227 - protein, 588 aa, Mannheimia haemolytica
MFKIKNSVILLNAVLLSACTSNGGSFDTNSVKASSSYSSSSKDSTAQPKSERRTISSTESLAQPSLGFQTKIPRRNFFGGTGEENGAIGEITPIVGEPGKPLSLEEEMKKLEEEVKKFGYDEDDIIHTHDGKKLHRKREMKFVRSGYFIHLGAAAETKREEPRLLKTGPTGYVYYLGTQPSKAFPTQVATYEGTWDFTTNASTKNKSKYFEGGAAGTNVGATPENNQANTEVEGNPIGHSSKFEVNFSDKTLKGTLTKNGYVNLRKKDKQEITDHYKIEANIHGNRFNGKAEALKTDDPYFGKDSNTVEGGFYGDKAQELAGKFLADDKSIFVVFAGKRDEKGEDKVEKKFDSVQVSLKDLAKSDMDTFGLATHLVIDGVQIALLPEGKTRFADMDFYQVLTKNINGKDYKITVCCNNLDYVKFGTFEQKGKDGHQYLVGERTAVADLPKEARIYRYTGTWNGSIRSKDERVGGDSPSDKAHGTRSIFNVNFADKKIEGKLIANDGLETNPMLTLDGKIEGNGFSGTAKTGEKGFNIDNKSTAGGTDVHLNAKFEGGFYGPQAAELGGIVHSAETNKDKVSITFGGKR

SEQ ID NO: 228 - protein, 555 aa, Bibersteinia trehalosi
VQSVKVESNKPDSPKPSLQDDNSSARRTINNTEATALLQPGFGFSAKIPRRNQLPQANENAAPIGEITPIAGDLTKIPYEEEVKAYGYDDEGFSHTHDGHNGHNTRDFKFVRSGYVLHSGAKPEIKHKEVLRTGAHGYVYYLGTHPAKAMPAQKAIYKGYWDFTTDARKDRDSQYFSNSAGVNIGATPENSRDVNLDDAEKPMGHTGEFTADFSNKTLTGTLVRNGYVKPRTNEQKITPLYDINATIQGNRFSGKANARNTEDPYFGKDSSTLEGGFFGDNTQELAGKFLADDKSIFVVFAGKRDAQENDSERAFDALKVSLKDLSKSEMDTFGNATHLLINNTQIPLIAEGKKSFAEMKFDDLVMPTVGGKTYRISVCCNNLDYVKFGTYSEENDKDSSHLYLVGERTAVADLPSGKAQYRGTWNGIMRSEAGSAGAESPSNSESGTRSLFDVDFANKKINGKLIANDGVEERPMLTLEGEIKANGFAGTAKTSDSGFNLDPKSTWGGTVIHVDSQFEGAFYGKNALELGGIVHDSNSKDKVSITFAGKRQIAK

SEQ ID NO: 229 - protein, 342 aa, Moraxella catarrhalis
EPAMGYGMALSKINLHNRQDTPLDEKNIITLDGKKQVAEGKKSPLPFSLDVENKLLDGYIAKMNVADKNAIGDRIKKGNKEISDEELAKQIKEAVRKSHEFQQVLSSLENKIFHSNDGTTKATTRDLKYVDYGYYLANDGNYLTVKTDKLWNLGPVGGVFYNGTTTAKELPTQDAVKYKGHWDFMTDVANRRNRFSEVKENSQAGWYYGASSKDEYNRLLTKEDSAPDGHSGEYGHSSEFTVNFKEKKLTGKLFSNLQDRHKGNVTKTERYDIDANIHGNRFRGSATASNKNDTSKHPFTSDANNRLEGGFYGPKGEELAGKFLTNDNKLFGVFGAKRESKA

SEQ ID NO: 230 - protein, 264 aa, Moraxella catarrhalis
EEKTEAILDAYALGTFNTSNATTFTPFTEKQLDNFGNAKKLVLGSTVIDLVPTDATKNEFTKDKPESATNEAGETLMVNDEVSVKTYGKNFEYLKFGELSIGGSHSVFLQGERTATTGEKAVPTTGTAKYLGNWVGYITGKDTGTGTGKSFTDAQDVADFDIDFGNKSVSGKLITKGRQDPVFSITGQIAGNGWTGTASTTKADAGGYKIDSSSTGKSIAIKDANVTGGFYGPNANEMGGSFTHNADDSKASVVFGTKRQQEVK

SEQ ID NO: 231 - protein, 284 aa, Mannheimia haemolytica
TVSASETEALLQPGFGFSAKIPRRNLLPQGKEDVAPIGDIKEITGDLPKIPYEEEVKACGSSADGFSHTHDRNHKLYTRDFNFVRSGYVVHSGPKPEIKPKEILRTGAHGYVYYLGIEPPKAIPTQKLTYKGYWDFTTYAAKGRDSNIFLIPAGINSGAIPENSHDINVDDSEKPMGHTGEFTADFANKTLTGTLVRNGYVSRSKEQKITTIYDIDAKIKGNRFSGKANPKKPMILIFGKSSTTLEGGFFGGEAQELAGKFLADDKSVFVVFAGTRDAKKDDSE

SEQ ID NO: 232 - protein, 235 aa, Mannheimia haemolytica
SAFDAFPIKLKDLNKSEMDTFGNATHLIINNKQIPLIAEATKSFAEMKFDTYRVSVCCNNLDYVKFGIYSEGNNSDTALQEYLVGERTALADLPTGTVKYRGTWDGVMYSKSGSAGVESPSNSESGTRSLFDVDFVNKKINGKLIANDGVEERPMLTLEGNLKGNGFGGTAKTGNSGFNLDPKSTNGGTVGHINTQFEGGFYGPKATELGGIVQNTETDKDRVSITFGGKRQIEK

SEQ ID NO: 233 - protein, 283 aa, Mannheimia haemolytica
TVSASETEALLQPGFGFSAKIPRRNLNPKGKEDVAPIGDITEITGDLTKIPHEEEVKKYGSSDDGFSHTHDGNHKLHTRDFNFVRSGYVLHSGAKPEIIRSDNILRIGAHGYVYYLGIEPAKAIPTQKATYKGYWDFTNDARKGRDSKYFSNSAGINIGAIPENSHDINVDDSTKPMGHTGEFTADFANKTLTGTLVRNGYVSRIKEQKITPIYDIDAKIKGNRFSGKANAKNANDPYFGKSSTTLEGGFFGGEAQELPVILADDKSVFVVFAGKRDAKENDG

SEQ ID NO: 234 - protein, 247 aa, Mannheimia haemolytica
ERTFDAFKIKLKDLNKSEMDTFGNATHLIINNKQIPLIAEGKKSFAEMKFDDLVTRTIDGKTYRVSVCCNNLDYVKFGIYSEGNNNNSDTAHQYLVGERTAVADLPTGTVKYRGTWDGVMYSKSGSAGAESPSNSESGTRSLFDVDFVNKKINGKLIANDGVEERPMLTLEGELKGNGFAGTAKTGDSGFNLDPKSTNGGTVVHMNAQFEGGFYGPKATELGGIVHSAETDKDKVSITFGGKRQIEK

SEQ ID NO: 235 - protein, 330 aa, Neisseria meningitidis
TKDKPANGNTAEASGGAGAATMPSETRLTTVLDAVELKSDGKKVENLDNFSDATRLVVDGIMIPLLSKDSESGDGQADKGKNGGTDFTYTTTYTPESDKKDTQAQTGAGGMQTASGAAGVNGGQAGTKTYKVKVCCSNLNYLKYGLLTRENSNSVMQTVRNSSQAAAAQTAQGAQSMFLQGERTDEKEIPKDENVVYLGTWYGHIATNGTSWTREASNQENGNRAKFDVNFKYKKITGTLTAENRSEATFTIDGMIQGNGFKGTAKTGNDGFAPDQNNSTVTHKVHIANAEVQGGFYGPNAEELGGWFAYPGNGQAKNATAVSGNGNSAG

SEQ ID NO: 236 - protein, 340 aa, Neisseria meningitidis
TQDKPENGAAASGGTDAAASNGAAGTSSENSKLTTVLDAVELKSGGKEVKNLDNFSNAAQLVVDGIMIPLLPKDSESGNTQADKGKNGGTEFTRKFEHTPESDKKDAQAGTQTNGAQTASNTAGDTNGKTKTYEVEVCCSNLNYLKYGMLTRKNSKSAMQAGENGSQADAKTEQVEQSMFLQGERTDEKEIPTDQNVVYRGSWYGYIANDKSTSWSGNASDREGGNRADFTVNFGEKKITGTLTAENRQAATFTIEGDIEGNGFSGTAKTDNLGFDLDQSDNTRTPKAYITDAKVQGGFYGPRAEELGGWFAYPGDKQTKNAPVASGNGNSASSATVVFG

SEQ ID NO: 237 - protein, 340 aa, Neisseria meningitidis
TQDKAANGNTAAASGGTDAAASGGAAGTSSENSKLTTVLDAVELTLNDKKIKNLDNFSNAAQLVVDGIMIPLLPKDSEIGSNQADKGKNGGTDFTRKFDHTPKSDEKDTQAQTGAGGAQTASGTEGVNGGQAGTKTYEVEVCCSNLNYLKYGMLTRKNSKSAMQAGGNSSQADAKTEQVEQSMFLQGERTDEKEIPKEQQDIVYRGSWYGHIASSTSWSGNASDKEGGNRAEFTVNFGTKKINGTLTAENRQQATFTIEGDIKDNGFEGTAKTAELGFDLDQSDNTRTPKAYITNAKVQGGFYGPKAEELGGWFAYPGDKQAQPPASGSGTSAANSATVV

SEQ ID NO: 238 - protein, 340 aa, Neisseria meningitidis
TKDKDANGNTEAASGGTGSAASGGVADMPSENGKLTTVLDAVELTLNDKKIKNLDNFSNAAQLVVDGIMIPLLPEASESGNNQANQGTNGGTAFTRKFDHTPNSDEKDTQAGTAENGNPAASNTAGDANGKTKTYAVEVCCSNLNYLKYGLLTRKTAGNTGEGGNGSPTAAQTDAQSMFLQGERTDEKEIPSEQNVVYRGSWYGHIANDTSWSGNASDREGGNRADFTVNFGTKKINGTLTAENRQQATFTIEGDIKDNGFEGTAKTADLGFDLDQSNTTGTPKAYITNAKVQGGFYGPKADELGGWFAYPGDKQTENATVASGNGNSASSATVVFGAKR

SEQ ID NO: 239 - protein, 350 aa, Neisseria meningitidis
TKDKDANGNTEAASGGTGAAASGGAAAMPSENGKLTTVLDAVELTRGGKAIKNLDNFSNAAQLVVDGIMIPLLPKDSESGNNQADKGKNGKNGKNGGTDFTYKTTYTPKSDEKDTQAGTPTNGAQTASNTAGDTNGKTKTYEVEVCCSNLNYLKYGMLTRKNSKSAMQAGESSSQADAKTEQVEQSMFLQGERTDEKEIPKEQNVVYRGSWYGHIANDTSWSGNASDKEGGNRAEFTVDFADKKITGKLTAENRQAQTFTIEGMIQGNGFEGTAKTAESGFDLDQKNTTRTPKAYITDAKVKGGFYGPKAEELGGWFAYPGDKQTKNATATSSDGKSASSATVVFGAKRQ

SEQ ID NO: 240 - protein, 340 aa, Neisseria meningitidis
TKDNTANGNTAAASGGAGAAASGGAAAMPSENSKLTTVLDAVELTHGGTAIKNLDNFSNAAQLVVDGIMIPLLPEASESGNTNQGTNGGTAFTRKFAHTPKSDEKDTQAGTAANGDQAASNTAGDTNGKTKTYEVEVCCSNLNYLKYGLLTRKTAGNTGEGGNGSPTAAQTGAQSMFLQGERTDEKEIPKEQQNIVYRGSWYGHIANGTSWSGNASNATSGNKADFTVNFGEKKINGTLTAENRQAATFTIEGMIQGNGFSGTAKTADLGFDLDQSNTTGTPKAYITNAKVQGGFYGPKAEELGGWFAYPGDKQTENATVASGNGNSASSATVVFGAKRQ

SEQ ID NO: 241 - protein, 340 aa, Neisseria meningitidis
TKDNTANGNTAAASGGAGAAASGGAAAMPSENSKLTTVLDAVELTHGGTAIKNLDNFSNAAQLVVDGIMIPLLPEASESGNTNQGTNGGTAFTRKFAHTPKSDEKDTQAGTAANGDQAASNTAGDTNGKTKTYEVEVCCSNLNYLKYGLLTRKTAGNTGEGGNGSPTAAQTGAQSMFLQGERTDEKEIPKEQQNIVYRGSWYGHIANGTSTSWSGNASDKEGGNRADFTVNFGEKKINGTLTAENRQQATFTIEGMIQGNGFSGTAKTADSGFDLDQSNTTGTPKAYITNAKVQGGFYGPKAEELGGWFAYPGDKQAQPPASGSGASAANSATVVFGAKR

SEQ ID NO: 242 - protein, 340 aa, Neisseria meningitidis
TQDKPGNGAAASDGAGAAASNGAAAMPSENGKLTTVLDAVELTHGGTAIKNLDNFSNAAQLVVDGIMIPLLPEASESGNNQANQGTNGGTAFTRKFDHTPKSDEKDTQAGTAANGNPAASNTAGDTNGKTKTYEVEVCCSNLNYLKYGLLTRKTAGNTVGSGNGSPTAAAQTDAQSMFLQGERTDEKEIPSEQNVVYRGSWYGHIANSTSWSGNASNATSGNKADFTVNFGEKKITGTLTAENRQAATFTIEGTIQGNGFSGTAKTADSGFDLDQSNTTGTPKAYITNAKVQGGFYGPKAEEMGGWFAYPGDSQTQPSASGSGASAANSATVVFGAKRQQ

SEQ ID NO: 243 - protein, 340 aa, Neisseria meningitidis
TQDKPGNGAAASDGAGAAASNGAAAMPSENGKLTTVLDAVELTHGGTAIKKLDNFSNAAQLVVDGIMIPLLPKDSESGNNQANQGTNGGTAFTRKFAHTPKSDEKDTQAGTAANGDQAASNTAGDTNGKTKTYEVEVCCSNLNYLKYGLLTRKTAGNTGEGGNSSPTAAQTAQGAQSMFLQGERTDENKIPTDQNVVYRGSWYGHIANGTSWSGNASDKEGGNRAEFTVNFDKKKINGTLTADNRQAATFTIEGDIEGNGFSGTAKTADSGFDLDQSNNTRTPKAYITNAKVQGGFYGPKAEELGGWFAYSDDKQTKNATDASGNGNSASSATVVFGAKR

SEQ ID NO: 244 - protein, 340 aa, Neisseria meningitidis
TQDKPGNGAAASDGAGAAASNGAAAMPSENGKLTTVLDAVELTHGGTAIKKLDNFSNAAQLVVDGIMIPLLPKDSESGNNQANQGTNGGTAFTRKFAHTPKSDEKDTQAGTAANGDQAASNTAGDTNGKTKTYEVEVCCSNLNYLKYGLLTRKTAGNTGEGGNGSPTAAQTGAQSMFLQGERTDEKEIPNDQNIVYRGSWYGHIANGTSWSGNASNATSGNRADFTVNFGEKKITGTLTAENRQAATFTIEGMIQGNGFEGTAKTGDGGFALDPKNTEASHKASINATVTGGFYGPKAEEMGGWFAYPGDSQTQPSASGSGASAANSATVVFGAKRQQLV

SEQ ID NO: 245 - protein, 340 aa, Neisseria meningitidis
TQDKPGNGAAASDGAGAAASNGAAAMPSENGKLTTVLDAVELTHGGTAIKKLDNFSNAAQLVVDGIMIPLLPEASESGNNQANQGTNGGTAFTRKFDYTPKSDEKDAQAGTAANGDQAASNTAGDANGKTKTYAVEVCCSNLNYLKYGLLTRKTAGNTGEGGNGSPTAAAQTDAQSMFLQGERTDEKEIPNDQNIVYRGSWYGHIANGTSWSGNASNATSGNKADFTVNFGEKKINGTLTAENRQAATFTIEGTIQGNGFSGTAKTADSGFDLDQSNTTGTPKAYITDAKVQGGFYGPKAEELGGWFAYPGDKQAQPSVSGSGASAANSATVVFGAKRQQ

SEQ ID NO: 246 - protein, 340 aa, Neisseria meningitidis
TKDNTANGNTAAASGGTGAAASGGAAAMPSENGKLTTVLDAVELKSGGKEVKNLDNFSNAAQLVVDGIMIPLLPEASESGHNQANQGTNGGTAFTRKFDYTPNSDEKDTQAGTAENGNPAASNTAGDANGKTKTYAVEVCCSNLNYLKYGLLTRKTAGNTVGSGNGSPTAAAQTAQGAQSMFLQGERTDENKIPSEQNVVYRGSWYGHIANGTSWSGNASDKEGGNRAEFTVNFADKKLDGTLTAGERTSPTFTITATIQGNGFEGTAKTADSGFDLDQSNTTRTPKAYITNAKVQGGFYGPKAEELGGWFVYPGDSQAQPSASGSGTSAANSATVVFGA

SEQ ID NO: 247 - protein, 340 aa, Neisseria meningitidis
TQDKDANGNTEAASGGTGAAASGGAAAMPSENGKLTTVLDAVELKSGGKEVKNLDNFSNAAQLVVDGIMIPLLPETSESGKNQADKGKNGETEFTRKFDYTPESDKKDTQAGTPTNGAQTASNTAGDTNGKTKTYEVEVCCSNLNYLKYGLLTRKTAGNTVGSGNGSQAAAQTDAQSMFLQGERTDEKEIPSEQNVVYRGSWYGHIANGTSWSGNASDKEGGNRAEFTVDFGAKKINGKLTAENRQAATFTIEGDIEGNGFSGTAKTAESGFDLDQSNTTRTPKAYITDAKVQGGFYGPKAEELGGWFAYPGDKQTKNATNASGNSSATVVFGAKRQQPV

SEQ ID NO: 248 - protein, 340 aa, Neisseria meningitidis
TQDKDANGNTEAASGGTGAAASGGAAAMPSENGKLTTVLDAVELKSGGKEVKNLDNFSNAAQLVVDGIMIPLLPETSESGKNQADKGKNGETEFTRKFDYTPESDKKDTQAGTPTNGAQTASNTAGDTNGKTKTYEVEVCCSNLNYLKYGLLTRKTAGNTVGSGNGSQAAAQTDAQSMFLQGERTDEKEIPSEQNVVYRGSWYGYIANDKSTSWSGNASNATSGNRAEFTVNFADKKITGTLTADNRQEATFTIDGNIKDNGFEGTAKTAESGFDLDQSNTTRTPKAYITDAKVQGGFYGPKAEELGGWFAYPGDKQTKNATNASGNSSATVVFGAKRQQ

SEQ ID NO: 249 - protein, 340 aa, Neisseria meningitidis; identical to SEQ ID NO: 194

SEQ ID NO: 250 - protein, 340 aa, Neisseria meningitidis
TQDKPENGAAASGGTGAAASGGAADMPSENGKLTTVLDAVELTHGGTAIKKLDNFSNAAQLVVDGIMIPLLPEASESGNNQANQGTNGGTAFTRKFDYTPKSDEKDAQAGTAANGDQAASNTAGDANGKTKTYAVEVCCSNLNYLKYGLLTRKTAGNTVGSGNGSPTAAAQTDAQSMFLQGERTDEKEIPNDQNIVYRGSWYGHIANGTSWSGNASNATSGNKADFTVNFGEKKINGTLTAENRQAATFTIEGMIQGNGFSGTAKTADLGFDLDQSNTTGTPKAYITNAKVQGGFYGPKAEELGGWFAYPGDKQAQPPASGSGASAANSATVVFGAKRQQ

SEQ ID NO: 251 - protein, 340 aa, Neisseria meningitidis
TQDKPGNGAAASGGAGAAASGGAADMPSENGKLTTVLDAVELTHGGKAIKNLDNFSNAAQLVVDGIMIPLLPEASESGNNQANQGTNGGTAFTRKFAHTPNSDEKDTQAGTAENGNPAASNTAGDTNGKTKTYAVEVCCSNLNYLKYGLLTRKTAGNTVEGGNGSPTAAQTAQGAQSMFLQGERTDEKEIPKEQQNIVYRGSWYGHIANGTSTSWSGNASDKEGGNRADFTVNFGEKKINGTLTAENRQQATFTIEGMIQGNGFSGTAKTADSGFDLDQSNTTGTPKAYITNAKVQGGFYGPKAEELGGWFAYPGDNQAQPSASGSGASAANSATVVFGA

SEQ ID NO: 252 - protein, 330 aa, Neisseria meningitidis
TQDKPGNGAAASDGAGAAASGDAADMPSENSKLTTVLDAVELTHSGKAIKNLDNFSNAAQLVVDGIMIPLLPETSESGKNQADKGKNGETEFTRKFDYTPESDKKDTQAGTPTNGAQTASNTAGDTNGKTKTYEVEVCCSNLNYLKYGLLTRKTAGNTVGSGNGSQAAAQTDAQSMFLQGERTDEKEIPSEQNVVYRGSWYGHIANGTSWSGNASDKEGGNRAEFTVDFGAKKINGKLTAENRQAATFTIEGDIEGNGFSGTAKTAESGFDLDQSNTTRTPKAYITDAKVQGGFYGPKAEELGGWFAYPGDKQTKNATNASGNSSATVVF

SEQ ID NO: 253 - protein, 340 aa, Neisseria meningitidis
TKDKPANGNTAEASGGTDAAASGGTAGTPSESTKLTTVLDAVELKSGGKEVKNLDNFSNAAQLVVDGIMIPLLPKDSESGNNQADKGKNGGTAFTYTTTYTPKSDKKDTQAQTVTGGTQTASGTEGVNGGQAGTKTYEVEVCCSNLNYLKYGLLTRKTAGNTGEGGNGSPTAAAQMAQGAQSMFLQGERTDEKEIPSDQNVVYRGSWYGHIANGTSWSGNASDKEGGNRAEFTVNFGEKKINGTLTAGERTSPTFTITATIQGNGFEGTAKTGDDGFALDTKNTVETHKAHIADAKVQGGFYGPKAEELGGWFAYPGDKQAQPSASGSGTSAANSATVVF

SEQ ID NO: 254 - protein, 340 aa, Neisseria meningitidis
TKDKPANGNTAEASGGTDAAASGGTAGTPSESTKLTTVLDAVELKSGGKEVKNLDNFSNAAQLVVDGIMIPLLPETSESGSNQADKGKNGETEFTRKFDHTPKSDKKDAQAGTQTNGAQTASNTAGDTNGKTKTYEVEVCCSNLNYLKYGMLTRKNSKSAMQAGENGSQADAKTEQVEQSMFLQGERTDEKEIPSEQNIVYRGSWYGHIANGTSTSWSGNASDKEGGNRADFTVNFGEKKINGTLTAENRQQATFTIEGMIQGNGFSGTAKTADSGFDLDQSNTTGTPKAYITNAKVQGGFYGPKAEELGGWFAYPGDKQAQPPASGSGASAANSATVVF

SEQ ID NO: 255 - protein, 340 aa, Neisseria meningitidis
TKDKPANGNTAEASGGTDAAASGGTAGTPSESTKLTTVLDAVELKSGGKEVKNLDNFSNAAQLVVDGIMIPLLPKDSESGGNQADKSKNGETAFTRKFDHTPKSDEKDTQAGTPTNGAQTASNTAGDTNGKTKTYEVEVCCSNLNYLKYGMLTRKNSKSAMQAGGNSSQADAKTEQVEQSMFLQGERTDEKEIPKEQQDIVYRGSWYGHIANGTSWSGNASDKEGGNRAEFTVNFGDKKITGTLTAENRQAATFTIEGDIEGNGFSGTAKTAELGFDLDQSDNTRTPKAYITDAKVKGGFYGPKAEELGGWFAYPSDKQTKNAPDASGNGNSASSATVVF

SEQ ID NO: 256 - protein, 340 aa, Neisseria meningitidis
TKDNTANGNTAAASGGTGAAASGGAADMPSENSKLTTVLDAVELTHGGTAIKNLDNFSNAAQLVVDGIMIPLLPEASESGNNQANQGTNGGTAFTRKFAHTPKSDEKDTQAGTAENGNPAASNTAGDTNGKTKTYAVEVCCSNLNYLKYGLLTRKTAGNTGEGGNGSPTAAAQTAQGAQSMFLQGERTDEKEIPSEQNVVYRGSWYGHIANDTSTSWSGNASDKEGGNRADFTVNFGEKKINGTLTAENRQAATFTIEGMIQGNGFSGTAKTADLGFDLDQSNTTGTPKAYITNAKVQGGFYGPKAEEMGGWFAYPGDKQTENATVASGNGNSASSATVV

SEQ ID NO: 257 - protein, 340 aa, Neisseria meningitidis
TKDKTENGAAASGGAGAAASGGAAAMPSENSKLTTVLDAVELTHSGTAIKNLDNFSNAAQLVVDGIMIPLLPEASESGNTNQGTNGGTAFTRKFDYTPNSDEKDTQAGTAENGNPAASNTAGDANGKTKTYAVEVCCSNLNYLKYGLLTRKTAGNTGEGGNGSPTAAAQTAQGAQSMFLQGERTDEKEIPSEQNVVYRGSWYGHIANGTSTSWSGNASDKEGGNRAEFTVNFGDKKITGTLTADNRQAATFTIEGDIEGNGFSGTAKTDNLGFDLDQSDNTRTPKAYITDAKVQGGFYGPKAEELGGWFAYPGDKQTEKATATSSDGKSASSATVVFGAK

SEQ ID NO: 258 - protein, 340 aa, Neisseria meningitidis
TQDKAANGNTAAASDGAGAAASGSAAAMPSENGKLTTVLDAVELTHGGKAIKNLDNFSNAAQLVVDGIMIPLLPKDSESGNNQANQGTNGGTAFTRKFDHTPQSDEKDAQAGTAANGDQAASNTAGDTNGKTKTYEVEVCCSNLNYLKYGLLTRKTAGNTGEGGNGSQTAAQTAQGAQSMFLQGERTDEKEIPSEQNVVYRGSWYGHIANDTSTSWSGNASNATSGNKADFTVNFGEKKINGTLTAENRQQATFTIEGMIQGNGFSGTAKTADSGFDLDQSNTTGTPKAYITNAKVQGGFYGPKAEELGGWFAYPGDKQAQPPASGSGASAANSATVVFG

SEQ ID NO: 259 - protein, 340 aa, Neisseria meningitidis
TQDKDANGNTEAASGGTGAAASGGAADMPSENSKLTTVLDAVELTHGGTAIKNLDNFSNAAQLVVDGIMIPLLPEASESGNTNQGTNGGTAFTRKFAHTPKSDEKDTQAGTAANGDQAASNTAGDTNGKTKTYEVEVCCSNLNYLKYGLLTRKTAGNTGEGGNGSPTAAQTAQGAQSMFLQGERTDENKIPSEQNVVYRGSWYGHIANGTSWSGNASNATSGNKADFTVNFGEKKITGTLTAENRQQATFTIEGMIQGNGFSGTAKTANSGFDLDQSNTTGTPKAYITNAKVQGGFYGPKAEELGGWFAYPGDKQTENTTVASGNGNSASSATVVFGAKR

SEQ ID NO: 260 - protein, 340 aa, Neisseria meningitidis
TQDKDANGNTEAASGGTGAAASGGAADMPSENSKLTTVLDAVELTHGGTAIKNLDNFSNAAQLVVDGIMIPLLPKDSESGNTNQGTNGGTAFTRKFDYTPKSDEKDAQAGTAANGDQAASNTAGDANGKTKTYAVEVCCSNLNYLKYGLLTRKTAGNTGEDGNGSPTAAAQTDAQSMFLQGERTDEKEILNDQNIVYRGSWYGHIANGTSWSGNASNATSGNKADFTVNFGEKKINGTLTAENRQAATFTIEGTIQGNGFSGTAKTADSGFDLDQSNTTGTPKAYITDAKVQGGFYGPKAEELGGWFAYPGNSQAQPPASGSGASAANSATVVFGAKRQQ

SEQ ID NO: 261 - protein, 340 aa, Neisseria meningitidis
TQDNTANGNTAAASGGAGAAASGGAADMPSENSKLTTVLDAVELTHGDTAIKNLDNFSNAAQLVVDGIMIPLLPKDSESGNNQANQGTNGGTAFTRKFAHTPKSDEKDAQAGTAANGDQAASNTAGDTNGKTKTYEVEVCCSNLNYLKYGLLTRKTAGNTGEGGNGSPTAAAQTAQGAQSMFLQGERTDENKIPSEQNVVYRGTWYGHIANDTSWSGNASDKEGGNKADFTVNFGEKKINGTLTAENRQAATFTIEGTIQGNGFSGTAKTADSGFDLDQSNTTRTPKAYITNAKVQGGFYGPKAEELGGWFAYPGDSQAQPSASGSGTSAANSATVVFGA

SEQ ID NO: 262 - protein, 340 aa, Neisseria meningitidis
TKDKDANGNTEAASGGTGAAASGGAADMPSENSKLTTVLDAVELTHGGTAIKNLDNFSNAAQLVVDGIMIPLLSETSESGNTNQGTNGGTAFTRKFNHTPTSDEKDTQAGTAENGNPAASNTAGDANGKTKTYEVEVCCSNLNYLKYGLLTRKTAGNTGEGGNGSQTAAQTDAQSMFLQGERTDENKIPTDQNVVYRGSWYGHIANGTSWSGNASDKEGGNRAEFTVNFADKKLDGTLTAGERTSPTFTITATIQGNGFEGTAKTGDGGFALDTKNTVETHKAHISNAKVQGGFYGSKAEELGGWFAYPGDSQAQPSASGSGTSAANSATVVFGAKRQQL

SEQ ID NO: 263 - protein, 340 aa, Neisseria meningitidis; identical to SEQ ID NO: 185

SEQ ID NO: 264 - protein, 350 aa, Neisseria meningitidis
TKDKPANGNTAAASGGTDAAASNGAAGTSSENGKLTTVLDAVELKLGDKEVQKLDNFSNAAQLVVDGIMIPLLPEASESGSNQADKGKKGKNGKNGGTDFTYKTTYTPKSDEKDTQAQTVTGGTQTASNTAGDANGKTKTYAVEVCCSNLNYLKYGLLTRKTAGNTVGSGNGSPTAAAQTAQGAQSMFLQGERTDEKEIPKEQNVVYRGSWYGHIANGTSWSGNASDKEGGNRADFTVNFGEKKINGTLTAENRQAATFTIEGTIQGNGFSGTAKTANSGFDLDQSNTTGTPKAYITDAKVQGGFYGPEAEELGGWFAYPGDSQAQPSASGSGTSAANSATVVFGAKRQQ

SEQ ID NO: 265 - protein, 340 aa, Neisseria meningitidis
TKDKPANGNTAAASGGTDAAASNGAAGTSSENGKLTTVLDAVELKLGDKEVQKLDNFSNAAQLVVDGIMIPLLPEASESGNNQANQGTNGGTAFTRKFDHTPESDEKDAQAGTQTNGAQTASNTAGDTNGKTKTYEVEVCCSNLNYLKYGMLTRKNSKSAMQAGESSSQADAKTEQVEQSMFLQGERTDEKEIPSEQNIVYRGSWYGYIANDKSTSWSGNASNATSGNRAEFTVNFADKKITGTLTADNRQEATFTIDGNIKDNGFEGTAKTAESGFDLDQSNTTRTPKAYITDAKVQGGFYGPKAEELGGWFAYPGDKQTKNATNASGNSSATVVFGAK

SEQ ID NO: 266 - protein, 340 aa, Neisseria meningitidis; identical to SEQ ID NO: 186

SEQ ID NO: 267 - protein, 330 aa, Neisseria meningitidis
TKDKPENGAAASGGTDAAASGGAAAMPSENGKLTTVLDAVELKSGDKEVKKLDNFSNAAQLVVDGIMIPLLPKDSESGNNQADKGKNGETEFTRKFDYTPESDKKDTQAGTPTNGAQTASNTAGDTNGKTKTYEVEVCCSNLNYLKYGLLTRKTAGNTVGSGNGSQAAAQTDAQSMFLQGERTDEKEIPSEQNVVYRGSWYGHIANGTSWSGNASDKEGGNRAEFTVDFGAKKINGKLTAENRQAATFTIEGDIEGNGFSGTAKTAESGFDLDQSNTTRTPKAYITDAKVQGGFYGPKAEELGGWFAYPGDKQTKNATNASGNSSATVVF

SEQ ID NO: 268 - protein, 330 aa, Neisseria meningitidis
TQDKPENGAAALGGAGAAASGGVAAMPSENGKLTTVLDAVELTHGGTAIKNLDNFSNAAQLVVDGIMIPLLPETSESGKNQADKGKNGETEFTRKFDYTPESDKKDTQAGTPTNGAQTASNTAGDTNGKTKTYEVEVCCSNLNYLKYGLLTRKTAGNTVGSGNGSQAAAQTDAQSMFLQGERTDEKEIPSEQNVVYRGSWYGHIANGTSWSGNASDKEGGNRAEFTVDFGAKKINGKLTAENRQAATFTIEGDIEGNGFSGTAKTAESGFDLDQSNTTRTPKAYITDAKVQGGFYGPKAEELGGWFAYPGDKQTKNATNASGNSSATVVF

SEQ ID NO: 269 - protein, 340 aa, Neisseria meningitidis
TKDKNANGNTPAASSGAGAAASGGAADTPSESTKLTTVLDAVELKSGGKEVKNLDNFSNAAQLVVDGIMIPLLPKDSESGNTQADKGKNGGTKFTRKFEHTPESDKKDAQAGTQTNGAQTASNTAGDTNGKTKTYEVEVCCSNLNYLKYGMLTRKNSKSAMQAGENGSQADAKTEQVEQSMFLQGERTDEKEIPKEQQDIVYRGSWYGHIAGSTSWSGNASNATSGNRAEFTVNFDTKKINGKLTAENRQEATFTIEGTIQDNGFEGTAKTADLGFDLDQSNTTGTPKAYITNAKVQGGFYGPKAEELGGWFAYPGDKQTKNATNASGNSSATVVFGAKR

SEQ ID NO: 270 - protein, 340 aa, Neisseria meningitidis
TKDKAESGGGNGASGGTGAAASGGAADTPSESTKLTTVLDAVELKSGGKKVENLDNFSNAAQLVVDGIMIPLLPEASESGNTNQGTNGGTAFTRKFDHTPESDKKDAQAGTQTNGAQTASNTAGDTNGKTKTYEVEVCCSNLNYLKYGMLTRKNSKSAMQAGENGSQADAKTEQVEQSMFLQGERTDEKEIPKEQQDIVYRGSWYGHIANDTSWSGNASDREGGNRADFTVNFGTKKINGTLTAENRQQATFTIEGDIKDNGFEGTAKTDDLGFDLDQKNTTRTPKAYITNAKVQGGFYGPKAEELGGWFAYLGDKQTEKATDASGNGNSASSATVVFGA

SEQ ID NO: 271 - protein, 340 aa, Neisseria meningitidis
TKDKTENGAVASGGTDAAASNGAAGTSSENSKLTTVLDAVELKLGDKEVQKLDNFSNAAQLVVDGIMIPLLPEASESGNNQANQGTNGGTAFTRKFDHTPESDKKDAQAGTQTNGAQTASNTAGDTNGKTKTYEVEVCCSNLNYLKYGMLTRKNSKSAMQAGESSSQADAKTEQVEQSMFLQGERTDEKEIPSEQNIVYRGSWYGYIANDKSTSWSGNASNATSGNRAEFTVNFADKKITGTLTADNRQEATFTIDGNIKDNGFEGTAKTAESGFDLDQSNTTRTPKAYITDAKVQGGFYGPKAEELGGWFAYPGDKQTKNATNASGNSSATVVFGAKRQ

SEQ ID NO: 272 - protein, 340 aa, Neisseria meningitidis
TKDKLENGAAASGSTGAAASNGAAGTSSENSKLTTVLDAVELKLGDKEVQKLDNFSNAAQLVVDGIMIPLLPKASESGNNQANQGTNGGTAFTYKTTYTLESDKKDTQAQTVTNGTQTASGTESVNGGQAGTKTYEVEVCCSNLNYLKYGLLTRKTAGNTGEGGNSSPTAAQTAQGAQSMFLQGERTDENKIPTDQNVVYRGSWYGHIANGTSWSGNASDKEGGNRAEFTVNFDKKKINGTLTADNRQAATFTIEGDIEGNGFSGTAKTADSGFDLDQSNNTRTPKAYITNAKVQGGFYGPKAEELGGWFAYSDDKQTKNATDASGNGNSASSATVVFGA

SEQ ID NO: 273 - protein, 340 aa, Neisseria meningitidis
TKDKAESGGGNGASGGTGAAASNSAAAMPSENGKLTTVLDAVELTHGGTAIKNLDNFSNAAQLVVDGIMIPLLPKASESGNNQANQGTNGGTAFTYKTTYTLESDKKDTQAQTVTNGTQTASGTESVNGGQAGTKTYEVEVCCSNLNYLKYGLLTRKTAGNTGEGGNSSPTAAQTAQGAQSMFLQGERTDENKIPTDQNVVYRGSWYGHIAGSTSWSGNASNATSGNRAEFTVNFDTKKINGKLTAENRQAATFTIVGDIKDNGFEGTAKTDNLGFDLDQSNTTGTPKAYITNAKVQGGFYGPKAEELGGWFAYSDDKQTKNATDASGNGNSASSATVVF

SEQ ID NO: 274 - protein, 340 aa, Neisseria meningitidis
TKDKLENGAAASGSTGAAASGGAAGTSSENSKLTTVLDAVELKSGGKEVQKLDNFSNAAQLVVDGIMIPLLPKDSESGGNQADKSKNGGTEFTRKFDHTPKSDDKDTKAQTGAAGSSGAQTDSGKADVNGGKAETKTYAVEVCCSNLNYLKYGLLTRKTAGNTVGSGNSSQAAAQTAQGAQSMFLQGERTDEKEIPTDQNVVYRGSWYGHIANDTSWSGNASNATSGNRAEFTVDFGAKKITGTLTAENRQEATFTIEGTIQDNGFEGTAKTADLGFDLDQSNTTGTPKAYITNAKVQGGFYGPKAEELGGWFAYPGDKQTKNATNASGNSSATVVFGAK

SEQ ID NO: 275 - protein, 350 aa, Neisseria meningitidis
TKDKPANGNTAAASGGTDAAASNGAAGTSSENGKLTTVLDAVELTLNDKKIKNLDNFSNAAQLVVDGIMIPLLPQNSTGENNQPDQGKNGGTAFIYKTTYTPKNDDKDTKAQTGAAGSSGAQTASGTESVTGGQAGTKTYEVEVCCSNLNYLKYGLLTRKTAGNTVGSGNSSQAAAQTAQGAQSMFLQGERTDEKEIPKEQQDIVYRGSWYGHIANGTSWSGNASDKEGGNRAEFTVNFGDKKITGTLTADNRQAATFTIEGDIEGNGFSGTAKTDNLGFDLDQSDNTRTPKAYITDAKVQGGFYGPKAEELGGWFAYPGDKQTEKATVASGDGKSASSATVVFGAKRQQ

SEQ ID NO: 276 - protein, 340 aa, Neisseria meningitidis
TQDKPGNGAAASGGTGAAASGGAADMPSENSKLTTVLDAVELTHGGTAIKNLDNFSNAAQLVVDGIMIPLLPEASESGHNQANQGTNGGTAFTRKFNHTPTSDEKDTQAGTAANGNQAASNTAGDANGKTKTYAVEVCCSNLNYLKYGLLTRKTAGNTGEGGNGSQTAAQTDAQSMFLQGERTDENKIPTDQNVVYRGSWYGHIANGTSWSGNASDKEGGNRAEFTVNFGEKKINGTLTAENRQAATFTIEGDIKDNGFEGTAKTADLGFDLDQSNTTGTPKAYITNAKVQGGFYGPKADELGGWFAYPGDNQAQPSASGSGASAANSATVVFGAKRQQL

SEQ ID NO: 277 - protein, 340 aa, Neisseria meningitidis
TKDNTANGNTAAASGGTGAAASGGAADMPSENSKLTTVLDAVELTLNDKKIKNLDNFSNAAQLVVDGIMIPLLPKDSESGNNQANQGTNGGTAFTRKFDHTPKSDEKDTQAGTAANGDQAASNTAGDTNGKTKTYEVEVCCSNLNYLKYGLLTRKTAGNTVGSGNGSPTAAQTDAQSMFLQGERTDEKEIPNDQNIVYRGSWYGHIANGTSWSGNASNATSGNKADFTVNFGEKKINGTLTAENRQAATFTIEGTIQGNGFSGTAKTADSGFDLDQSNTTGTPKAYITNAKVQGGFYGPKAEEMGGWFAYPGDKQAQPSASGSGASAANSATVVFGAKRQ

SEQ ID NO: 278 - protein, 340 aa, Neisseria meningitidis
TQDKPENGAAALGGAGAAASGGVAAMPSENGKLTTVLDAVELTHGGTAIKNLDNFSNAAQLVVDGIMIPLLPEASESGNNQANQGTNGGTAFTRKFDHTPKSDEKDTQAGTAANGDQAASNTAGDTNGKTKTYEVEVCCSNLNYLKYGLLTRKTAGNTGEGGNGSPTAAQTAQGAQSMFLQGERTDENKIPSEQNVVYRGSWYGHIANGTSWSGNASNATSGNKADFTVNFGEKKITGTLTAENRQQATFTIEGMIQGNGFSGTAKTADSGFDLDQSNTTGTPKAYITNAKVQGGFYGPKAEELGGWFAYPGDKQAQPSASGSGASAANSATVVFGAKRQ

SEQ ID NO: 279 - protein, 539 aa, Neisseria meningitidis
NSGAAYGFAVKLPRRNAHFNPKYKEKHKPLGSMDWKKLQRGEPNSFSERDELEKKRGSSELIESKWEDGQSRVVGYTNFTYVRSGYVYLNKNNIDIKNNIVLFGPDGYLYYKGKEPSKELPSEKITYKGTWDYVTDAMEKQRFEGLGSAAGGDKSGALSALEEGVLRNQAEASSGHTDFGMTSEFEVDFSDKTIKGTLYRNNRITQNNSENKQIKTTRYTIQATLHGNRFKGKALAADKGATNGSHPFISDSDSLEGGFYGPKGEELAGKFLSNDNKVAAVFGAKQKDKKDGENAAGPATETVIDAYRITGEEFKKEQIDSFGDVKKLLVDGVELSLLPSEGNKAAFQHEIEQNGVKATVCCSNLDYMSFGKLSKENKDDMFLQGVRTPVSDVAARTEANAKYRGTWYGYIANGTSWSGEASNQEGGNRAEFDVDFSTKKISGTLTAKDRTSPAFTITAMIKDNGFSGVAKTGENGFALDPQNTGNSHYTHIEATVSGGFYGKNAIEMGGSFSFPGNAPEGKQEKASVVFGAKRQQLVQ

SEQ ID NO: 280 - protein, 280 aa, Neisseria meningitidis
NSGAAYGFAVKLPRRNAHFNPKYKEKHKPLGSMDWKKLQRGEPNSFSERDELEKKRGSSELIESKWEDGQSRVVGYTNFTYVRSGYVYLNKNNIDIKNNIVLFGPDGYLYYKGKEPSKELPSEKITYKGTWDYVTDAMEKQRFEGLGSAAGGDKSGALSALEEGVLRNQAEASSGHTDFGMTSEFEVDFSDKTIKGTLYRNNRITQNNSENKQIKTTRYTIQATLHGNRFKGKALAADKGATNGSHPFISDSDSLEGGFYGPKGEELAGKFLSNDNKVAA

SEQ ID NO: 281 - protein, 654 aa, Neisseria meningitidis
QGGYGFAMRLKRRNWYPGAEESEVKLNESDWEATGLPTKPKELPKRQKSVIEKVETDGDSDIYSSPYLTPSNHQNGSAGNGVNQPKNQATGHENFQYVYSGWFYKHAASEKDFSNKKIKSGDDGYIFYHGEKPSRQLPASGKVIYKGVWHFVTDTKKGQDFREIIQPSKKQGDRYSGFSGDGSEEYSNKNESTLKDDHEGYGFTSNLEVDFGNKKLTGKLIRNNASLNNNTNNDKHTTQYYSLDAQITGNRFNGTATATDKKENETKLHPFVSDSSSLSGGFFGPQGEELGFRFLSDDQKVAVVGSAKTKDKLENGAAASGSTGAAASGGAAGTSSENSKLTTVLDAVELTLNDKKIKNLDNFSNAAQLVVDGIMIPLLPKDSESGNTQADKGKNGGTEFTRKFEHTPESDKKDAQAGTQTNGAQTASNTAGDTNGKTKTYEVEVCCSNLNYLKYGMLTRKNSKSAMQAGGNSSQADAKTEQVEQSMFLQGERTDEKEIPTDQNVVYRGSWYGHIANGTSWSGNASDKEGGNRAEFTVNFADKKITGKLTAENRQAQTFTIEGMIQGNGFEGTAKTAESGFDLDQKNTTRTPKAYITDAKVKGGFYGPKAEELGGWFAYPGDKQTEKATATSSDGNSASSATVVFGAKRQQPVQ

SEQ ID NO: 282 - protein, 303 aa, Neisseria meningitidis
QGGYGFAMRLKRRNWYPGAEESEVKLNESDWEATGLPTKPKELPKRQKSVIEKVETDGDSDIYSSPYLTPSNHQNGSAGNGVNQPKNQATGHENFQYVYSGWFYKHAASEKDFSNKKIKSGDDGYIFYHGEKPSRQLPASGKVIYKGVWHFVTDTKKGQDFREIIQPSKKQGDRYSGFSGDGSEEYSNKNESTLKDDHEGYGFTSNLEVDFGNKKLTGKLIRNNASLNNNTNNDKHTTQYYSLDAQITGNRFNGTATATDKKENETKLHPFVSDSSSLSGGFFGPQGEELGFRFLSDDQKVAV

SEQ ID NO: 283 - protein, 513 aa, Haemophilus parasuis
EYKDVETDKKVKEQLGELMEPALGYVVKVPVSQSGVKRTEISNPEAITDEDLNKIPNYEIIKGVAYPNYGELVDKTAAETMKYVRSGYVIDVYHSGTRDKGYVFYKGITPSKELPQGPALTYQGEWDFTSDANLNNEEGRPTYLNDDYYTTWIGKRAGLVSGDAKPSKHKYTSQFKVDFATKKMTGKLSDKEKTIYTVNADIRGNRFTGSATASDKDKGKGASYNFFSVDSQSLEGGFYGPKAEEMAGKFVADDKSLFAVFSAKHNASNVNTVRIIDASKIDLTNFSISELTNFGDASVLIIDGKKMELAGSEFTNKHTIDINGKKMVAVACCSNLEYMKFGQLWQQTEGEKQVKDNSLFLQGERTATDKMPKDGNYKYIGTWDAQVSKENNYWVATADDDRKAGYRTEFDVDFGSKNLSGKLFDKNGVNPVFTVNAKIDGNGFTGEAKTSDAGFVLDPGSLRHDNVKFSDVAVSGGFYGPTAAELGGQFRYQSDNGSVGVGAVFGAKQQVKK

SEQ ID NO: 284 - DNA, 2114 bp, Neisseria meningitidis
tgtatcggcggcaatttcggcgtgcagcctgttgtcgaatcaacgccgacgtcactttcaagtctaaggacgttcccactccgccccctgccaaaccttctatagaaatcacgccggtcaaccggcccgccgtcggtgcggcaatgcggctgccaaggcggaatactgcttttcatcgtgaagatggcacggaaattccaaatagcaaacaagcagaagaaaagctgtcgtttcaagaaggtgatgttctgtttttatacggttcaaaaggaaataaacttcaacaacttaaaagcgaaattcataaacgtgattccgatgtagaaattaggacatcagaaaaggaaaataaaaaatatgattataaatttgtagatgcaggttatgtatatgtaaagggaaaagatgaaattaagtggacttcagattacaagcagttttccaaccgcttaggttatgacggttttgtatattattccggagaacgtccttcccaatctttaccgagtgcgggaacggtggaatattttggtaactggcaatatatgaccgatgccaaacgtcatcgagcaggtaaggcggttggcattgacaatttgggttattacacattttatggtaacgatgttggtgcaacttcttatgcggctaaggatgtcgacgaaagggaaaaacatcctgctaaatatacggtagatttcggtaacaaaaccctgacgggcgagctgattaaaaaccaatatgtcaaacccagtgagaagcaaaaaccgctgaccatttacaacatcactgccgatttaaacggcaaccgctttaccggcagtgccaaggtcaatcctgatttagcgaaaagccatgccaataaggagcatttgtttttccatgccgatgccgatcagcggcttgagggcggttttttcggcgataagggggaagagcttgccggacggtttatcagcaacgacaacagcgtattcggtgtattcgcaggcaaacaaaatagccccgtgccgtctggaaaacacaccaaaatcttggattctctgaaaatttccgttgatgaggcaagtggtgaaaatccccgaccgtttgccatttctcctatgcccgattttggtcatcccgacaaacttcttgtcgaagggcatgaaattcctttggttagccaagagaaaaccatcgagcttgccgacggcaggaaaatgaccgtcagtgcttgttgcgactttttgacctatgtgaaactcggacggataaaaaccgaacgtcccgccgccaaaccgaaggcgcaggacgaagaggattcggacattgataatggcgaagaaagcgaagacgaaatcggcgatgaagaagaaggcaccgaagatgcagccgcaggagatgaaggcagcgaagaagacgaagccacagaaaacgaagacggcgaagaagacgaagctgaagaacctgaagaagaatcgtcggcagaaggcaacggcagttcaaacgccatcctgcctgtcccggaagcctctaaaggcagggatatcgaccttttcctgaaaggtatccgcacggcagaaacgaatattccgcaaactggagaagcacgctataccggcacttgggaagcgcgtatcggcaaacccattcaatgggacaatcatgcggataaagaagcggcaaaagcagtatttaccgttgatttcggcaagaaatcgatttccggaacgctgacggagaaaaacggtgtagaacctgctttccgtattgaaaacggcgtgattgagggcaacggtttccatgcgacagcgcgcactcgggatgacggcatcgacctttccgggcagggttcgaccaaaccgcagatcttcaaagctaatgatcttcgtgtagaaggaggattttacggcccgaaggcggaggaattgggcggtattattttcaataatgatgggaaatctcttggtataactgaaggtactgaaaataaagttgaagctgatgttgatgttgatgttgatgttgatgttgatgttgatgctgatgttgaacagttaaaacctgaagttaaaccccaattcggcgtggtattcggtgcgaagaaagataataaagaggtggaaaaatga

SEQ ID NO: 285 - protein, 707 aa, Neisseria meningitidis
CIGGNFGVQPVVESTPTAYPVTFKSKDVPTPPPAKPSIEITPVNRPAVGAAMRLPRRNTAFHREDGTEIPNSKQAEEKLSFQEGDVLFLYGSKGNKLQQLKSEIHKRDSDVEIRTSEKENKKYDYKFVDAGYVYVKGKDEIKWTSDYKQFSNRLGYDGFVYYSGERPSQSLPSAGTVEYFGNWQYMTDAKRHRAGKAVGIDNLGYYTFYGNDVGATSYAAKDVDEREKHPAKYTVDFGNKTLTGELIKNQYVKPSEKQKPLTIYNITADLNGNRFTGSAKVNPDLAKSHANKEHLFFHADADQRLEGGFFGDKGEELAGRFISNDNSVFGVFAGKQNSPVPSGKHTKILDSLKISVDEASGENPRPFAISPMPDFGHPDKLLVEGHEIPLVSQEKTIELADGRKMTVSACCDFLTYVKLGRIKTERPAAKPKAQDEEDSDIDNGEESEDEIGDEEEGTEDAAAGDEGSEEDEATENEDGEEDEAEEPEEESSAEGNGSSNAILPVPEASKGRDIDLFLKGIRTAETNIPQTGEARYTGTWEARIGKPIQWDNHADKEAAKAVFTVDFGKKSISGTLTEKNGVEPAFRIENGVIEGNGFHATARTRDDGIDLSGQGSTKPQIFKANDLRVEGGFYGPKAEELGGIIFNNDGKSLGITEGTENKVEADVDVDVDVDVDVDADVEQLKPEVKPQFGVVFGAKKDNKEVEK

SEQ ID NO: 286 - protein, 15 aa, Neisseria meningitidis
YGTDEAEKFRDKSGV

SEQ ID NO: 287 - protein, 15 aa, Neisseria meningitidis
LNRWVKERIEQNQPL

SEQ ID NO: 288 - DNA, 852 bp, Haemophilus somnus
gaaacccgctttgatgccgttaaaatcagcacggatagtaataaattagaaaaagaaacgatggatacgttcggcaatgcggcgtatttagtgttggacggcagacagtttcctttggtgccggaaagtaatgccggtacgacgggcgctggcaacacaggcaagaatgagtttatcagcaccatagacggtagccatttaaacaaaacaaatcatgaaaaccacaaaaaatacaaagttaccgtatgttgcagtaatttggtgtatgtgaaattcggcagctatggggaacaaacaacagcaaacgatgcttcaaacagcactgccggtgcagcaactacgcataacagcacattaacaaacggacaccttttcctaacaggtgaacgtacttcgcttactgatatggcgaagcaaagtggtgcagcaaagtatattggcacatggcaagccaactttttaagtagcaaaggacaggttggcagtgttgacgccggtgatccgcgtaacgatagtggtaaaagccgtgctgaatttgatgttaattttggtggtaagacagttacaggcaagttttttgatgccgacggtattcaacccgccctcacaatggatagtaccaagattgaaggtaacggcttctcgggtacagctaagacaactggtagtttgcaattagataaaggcagtacaggtgcgggtataacagtaaccttcaccgatgctaaagtcgatggcgcattctacggtccgaatgcagaagaaatcggcggtaccatcacatcgaatggcacgggcgataaagtcggtggggtgttcggtgcgaaacgccaagaactatcgcaacagaaa

SEQ ID NO: 289 - protein, 284 aa, Haemophilus somnus
ETRFDAVKISTDSNKLEKETMDTFGNAAYLVLDGRQFPLVPESNAGTTGAGNTGKNEFISTIDGSHLNKTNHENHKKYKVTVCCSNLVYVKFGSYGEQTTANDASNSTAGAATTHNSTLTNGHLFLTGERTSLTDMAKQSGAAKYIGTWQANFLSSKGQVGSVDAGDPRNDSGKSRAEFDVNFGGKTVTGKFFDADGIQPALTMDSTKIEGNGFSGTAKTTGSLQLDKGSTGAGITVTFTDAKVDGAFYGPNAEEIGGTITSNGTGDKVGGVFGAKRQELSQQK

SEQ ID NO: 290 - protein, 272 aa, Haemophilus influenzae
TKKPDATTSTTANAKTDATTNAENFTTKDISSFGEADYLLIDNYPVPLLPETENSGDFATSKHYEVRDKTYKVEACCKNLSYVKFGMYYEDNKKNNKNETEQYHQFLLGLRTASSKIPTTGNVKYRGSWFGYISDGETSYSTTGDKRQDKNAVAEFDVNFAEKTLKGSLKRADSQNPVFSIEANFKNGGNAFTGTATAKDLVIDGKNSQTKNTPINITTKVNGAFYGPNASELGGYFTYNGKNPTDKNSPTASSPSNSEKARAAVVFGAKKQ

SEQ ID NO: 291 - protein, 254 aa, Moraxella bovis
VQTQFDATAIDSKTLTKTNMDTFGQASHLVIDGKLVSLLPEGVSSFADMKFINTHQIAHGDKKLSITVCCNNLDYVKFGGYGTVGGTADTPVLSDGKLFLVGERTDTSAIPTSGTAHYRGTWEGYIDSKDGRRWASSASNLTTGTRSRFDVDFGSKSLIGKLIADNGLEDNPVLTLNGTITGNGFSGTAKTGVNGFNLDPNSTGASAIAHINADFHGGFYGVNASELGGVIHHDKVGEDKIGVVFGGKRQTNTP

SEQ ID NO: 292 - protein, 232 aa, Bibersteinia trehalosi
LKDLSKSEMDTFGNATHLIINNKQLPLIAEGKQSFADMQFNDTVTHNIGGKTYRVSVCCNNLDYVKFGTYSEEDNKDSAHLYLVGERTAVSDLPSGKAQYRGTWNGVIHSHSGTVGGESPSNSESGTRSLFDVDFANKKINGKLIANDGVEERPMLSLEGEIKANGFSGSAKTHDSGFNIDPKSTAGGTEVHLDSRFEGAFYGKNALELGGIVHDSHSKDKVSITFAGKRQI

SEQ ID NO: 293 - skipped

SEQ ID NO: 294 - protein, 243 aa, Haemophilus parasuis
NTVRIIDASKIDLTNFSISELTNFGDASVLIIDGKKMELAGSEFTNKHTIDINGKKMVAVACCSNLEYMKFGQLWQQTEGEKQVKDNSLFLQGERTATDKMPKDGNYKYIGTWDAQVSKENNYWVATADDDRKAGYRTEFDVDFGSKNLSGKLFDKNGVNPVFTVNAKIDGNGFTGEAKTSDAGFVLDPGSLRHDNVKFSDVAVSGGFYGPTAAELGGQFRYQSDNGSVGVGAVFGAKQQVKK

SEQ ID NO: 295 - protein, 50 aa, Neisseria meningitidis
DNHADKEAAKAVFTVDFGKKSISGTLTEKNGVEPAFRIENGVIEGNGFHA

SEQ ID NO: 296 - protein, 505 aa, Actinobacillus pleuropneumoniae
EEYKDVETAKKEKEQLGELMEPALGYVVKVPVSSFENKKVDISDIEVITNGNLDDVPYKANSSKYNYPDIKTKDSSLQYVRSGYVIDGEHSGSNEKGYVYYKGNSPAKELPVNQLLTYTGSWDFTSNANLNNEEGRPNYLNDDYYTKFIGKRVGLVSGDAKPAKHKYTSQFEVDFATKKMTGKLSDKEKTIYTVNADIRGNRFTGAATASDKNKGKGESYNFFSADSQSLEGGFYGPKAEEMAGKFVANDKSLFAVFSAKHNGSNVDTVRIIDASKIDLTNFSISELNNFGDASVLIIDGKKIKLAGSGFTNKHTIEINGKTMVAVACCSNLEYMKFGQLWQQAEGGKPENNSLFLQGERTATDKMPKGGNYKYIGTWDAQVSKENNWVATADDDRKAGYRTEFDVDFGNKNLSGKLFDKNGVNPVFTVDAKIDGNGFTGKAKTSDAGFALDSGSSRYENVKFNDVAVSGGFYGPTAAELGGQFHHKSENGSVGAVFGAKQQVKK

SEQ ID NO: 297 - protein, 503 aa, Actinobacillus pleuropneumoniae
VNYTDEETQKRKKEELDKLMEPALGYVTKIPVNIPSVRKTEISEIDTVTDESLSLVPNEDKLRTIANENYGSVVTKSGSNTMNFVRSGYTIDVVHYGLRDKGYVYYKGVHPSKELPKGNIIVYQGEWDFTSNADLDAKRPNYNPEFNGYGAGQRVGVTSADAKERTYISKFNIDFSNKKLNGQLLTKTKENQEKLRYSVEANISGNRFRGKATATDKTDPILGKDSEHLEGGLYGPKSEELAGKFVAHDKSLFAVFSGKRGNDVLETVKIIDASKIDLTTFESSELNNFGNANVLIIDGQKIDLAGADFKNRKTVDINGKTMVAIACCSNLEYMKFGQLWQKEGEQTKDNSLFLQGERTATDKIPVGGNYKYVGTWDALVSKGTNWVAEADNNRESGYRSEFDVNFGDKKVSGKLFDKGGIVPVFMINADIKGNGFTGTANTTDTGFALDSGSSQHGNAVFSDIKVNGGFYGPTAGELGGQFHHKSDNGSVGAVFGAKRQIEK

SEQ ID NO: 298 - protein, 551 aa, Actinobacillus suis
SYQDEETKKKTKEELDKLMEPTLGVEAKIPRRNRALFDKEGNRKATPDTTDELSEAQIMAIWNENIDEIPHLKELNDKTTSGLIYHSHDGKQEDKKRNLQYVRSGYVFDESYSEIVKNKNGVPYIFKNGIDGYIYYLGTSPSKELPKGNKVTYKGTWDFTSDVKTSYELSGFSDAGNGKNVAATSISDNVNRDHKVGEKLGDNEVKGVAHSSEFAVDFDNKKLTGSLYRNGYINRNKAQEVTKRYSIEADITGNRFTGKAKAEKAGDPIFTDSNYLEGGFYGPKAEEMAGKFFTNNKSLFAVFAAKSENGETTTERIIDATKIDLTQFNAKELNNFGDASVLIIDGQKIDLAGVNFKNSKTVEINGKTMVAVACCSNLEYMKFGQLWQKEGKQQVKDNSLFLQGERTATDKMPAGGNYKYVGTWDALVSKGTNWIAEADNNRESGYRTEFDVNFSDKKVNGKLFDKGGVNPVFTVDATINGNGFIGSAKTSDSGFALDAGSSQHGNAVFSDIKVNGGFYGPTAGELGGQFHHKSDNGSVGAVFGAKRQIEK

SEQ ID NO: 299 - DNA, 1707 bp, Neisseria meningitidis; identical to SEQ ID NO: 149

SEQ ID NO: 300 - protein, 569 aa, Neisseria meningitidis; identical to SEQ ID NO: 150

SEQ ID NO: 301 - DNA, 744 bp, Neisseria meningitidis
ggggaaaacgcggcagggcctgcaacggaaaccgtgatagatgcataccgtattaccggcgaggagtttaagaaagagcaaatagacagttttggagatgtgaaaaagctgctggttgacggagtggagctttcactgctgccgtctgagggcaataaggcggcatttcagcacgagattgagcaaaacggcgtgaaggcaacggtgtgttgttccaacttggattacatgagttttgggaagctgtcaaaagaaaataaagacgatatgttcctgcaaggtgtccgcactccagtatccgatgtggcggcaaggacggaggcaaacgccaaatatcgcggtacttggtacggatatattgccaacggcacaagctggagcggcgaagcctccaatcaggaaggtggtaatagggcagagtttgacgtggatttttccactaaaaaaatcagtggcacactgacggcaaaagaccgtacgtctcctgcgtttactattactgccatgattaaggacaacggtttttcaggtgtggcgaaaaccggtgaaaacggctttgcgctggatccgcaaaataccggaaattcccactatacgcatattgaagccactgtatccggcggtttctacggcaaaaacgccatcgagatgggcggatcgttctcatttccgggaaatgcaccagagggaaaacaagaaaaagcatcggtggtattcggtgcgaaacgccaacagcttgtgcaa

SEQ ID NO: 302 - protein, 248 aa, Neisseria meningitidis
GENAAGPATETVIDAYRITGEEFKKEQIDSFGDVKKLLVDGVELSLLPSEGNKAAFQHEIEQNGVKATVCCSNLDYMSFGKLSKENKDDMFLQGVRTPVSDVAARTEANAKYRGTWYGYIANGTSWSGEASNQEGGNRAEFDVDFSTKKISGTLTAKDRTSPAFTITAMIKDNGFSGVAKTGENGFALDPQNTGNSHYTHIEATVSGGFYGKNAIEMGGSFSFPGNAPEGKQEKASVVFGAKRQQLVQ

SEQ ID NO: 303 - DNA, 955 bp, Neisseria meningitidis
ggatcttctgaaaacagtaagctgaccacggttttggatgcggttgaattgacactaaacgacaagaaaatcaaaaatctcgacaacttcagcaatgccgcccaactggttgtcgacggcattatgattccgctcctgcccaaggattccgaaagcgggaacactcaggcagataaaggtaaaaacggcggaacagaatttacccgcaaatttgaacacacgccggaaagtgataaaaaagacgcccaagcaggtacgcagacgaatggggcgcaaaccgcttcaaatacggcaggtgataccaatggcaaaacaaaaacctatgaagtcgaagtctgctgttccaacctcaattatctgaaatacggaatgttgacgcgcaaaaacagcaagtccgcgatgcaggcaggaggaaacagtagtcaagctgatgctaaaacggaacaagttgaacaaagtatgttcctccaaggcgagcgtaccgatgaaaaagagattccaaccgaccaaaacgtcgtttatcgggggtcttggtacgggcatattgccaacggcacaagctggagcggcaatgcttctgataaagagggcggcaacagggcggaatttactgtgaattttgccgataaaaaaattaccggcaagttaaccgctgaaaacaggcaggcgcaaacctttaccattgagggaatgattcagggcaacggctttgaaggtacggcgaaaactgctgagtcaggttttgatctcgatcaaaaaaataccacccgcacgcctaaggcatatatcacagatgccaaggtaaagggcggtttttacgggcctaaagccgaagagttgggcggatggtttgcctatccgggcgataaacaaacggaaaaggcaacagctacatccagcgatggaaattcagcaagcagcgcgaccgtggtattcggtgcgaaacgccaacagc

SEQ ID NO: 304 - protein, 318 aa, Neisseria meningitidis
GSSENSKLTTVLDAVELTLNDKKIKNLDNFSNAAQLVVDGIMIPLLPKDSESGNTQADKGKNGGTEFTRKFEHTPESDKKDAQAGTQTNGAQTASNTAGDTNGKTKTYEVEVCCSNLNYLKYGMLTRKNSKSAMQAGGNSSQADAKTEQVEQSMFLQGERTDEKEIPTDQNVVYRGSWYGHIANGTSWSGNASDKEGGNRAEFTVNFADKKITGKLTAENRQAQTFTIEGMIQGNGFEGTAKTAESGFDLDQKNTTRTPKAYITDAKVKGGFYGPKAEELGGWFAYPGDKQTEKATATSSDGNSASSATVVFGAKRQQ

SEQ ID NO: 305 - protein, 321 aa, Neisseria meningitidis
SSSENSKLTTVLDAVELTLNDKKIKNLDNFSNAAQLVVDGIMIPLLPKDSESGNTQADKGKNGGTEFTRKFEHTPESDKKDAQAGTQTNGAQTASNTAGDTNGKTKTYEVEVCCSNLNYLKYGMLTRKNSKSAMQAGGNSSQADAKTEQVEQSMFLQGERTDEKEIPTDQNVVYRGSWYGHIANGTSWSGNASDKEGGNRAEFTVNFADKKITGKLTAENRQAQTFTIEGMIQGNGFEGTAKTAESGFDLDQKNTTRTPKAYITDAKVKGGFYGPKAEELGGWFAYPGDKQTEKATATSSDGNSASSATVVFGAKRQQPVQ

SEQ ID NO: 306 - protein, 244 aa, Neisseria meningitidis
SSSENSKLTTVLDAVELTLNDKKIKNLDNFSNAAQLVVDGIMIDLAGTEFTRKFEHTTNGKTYEVEVCCSNLNYLKYGMLTRKGKQVEQSMFLQGERTDEKEIPTDQNVVYRGSWYGHIANGTSWSGNASDKEGGNRAEFTVNFADKKITGKLTAENRQAQTFTIEGMIQGNGFEGTAKTAESGFDLDQKNTTRTPKAYITDAKVKGGFYGPKAEELGGWFAYHKSDNGSATVVFGAKRQQPVQ

SEQ ID NO: 307 - protein, 304 aa, Neisseria meningitidis
SSSENSKLTTVLDAVELTLNDKKIKNLDNFSNAAQLVVDGIMIDLAGTEFTRKFEHTPESDKKDAQAGTQTNGAQTASNTAGDTNGKTKTYEVEVCCSNLNYLKYGMLTRKNSKSAMQAGGNSSQADAKTEQVEQSMFLQGERTDEKEIPTDQNVVYRGSWYGHIANGTSWSGNASDKEGGNRAEFTVNFADKKITGKLTAENRQAQTFTIEGMIQGNGFEGTAKTAESGFDLDQKNTTRTPKAYITDAKVKGGFYGPKAEELGGWFAYPGDKQTEKATATSSDGNSASSATVVFGAKRQQPVQ

SEQ ID NO: 308 - protein, 293 aa, Neisseria meningitidis
SSSENSKLTTVLDAVELTLNDKKIKNLDNFSNAAQLVVDGIMIPLLPKDSESGNTQADKGKNGGTEFTRKFEHTINGKTYEVEVCCSNLNYLKYGMLTRKNSKSAMQAGGNSSQADAKTEQVEQSMFLQGERTDEKEIPTDQNVVYRGSWYGHIANGTSWSGNASDKEGGNRAEFTVNFADKKITGKLTAENRQAQTFTIEGMIQGNGFEGTAKTAESGFDLDQKNTTRTPKAYITDAKVKGGFYGPKAEELGGWFAYPGDKQTEKATATSSDGNSASSATVVFGAKRQQPVQ

SEQ ID NO: 309 - protein, 303 aa, Neisseria meningitidis
SSSENSKLTTVLDAVELTLNDKKIKNLDNFSNAAQLVVDGIMIPLLPKDSESGNTQADKGKNGGTEFTRKFEHTPESDKKDAQAGTQTNGAQTASNTAGDTNGKTKTYEVEVCCSNLNYLKYGMLTRKGKQVEQSMFLQGERTDEKEIPTDQNVVYRGSWYGHIANGTSWSGNASDKEGGNRAEFTVNFADKKITGKLTAENRQAQTFTIEGMIQGNGFEGTAKTAESGFDLDQKNTTRTPKAYITDAKVKGGFYGPKAEELGGWFAYPGDKQTEKATATSSDGNSASSATVVFGAKRQQPVQ

SEQ ID NO: 310 - protein, 307 aa, Neisseria meningitidis
SSSENSKLTTVLDAVELTLNDKKIKNLDNFSNAAQLVVDGIMIPLLPKDSESGNTQADKGKNGGTEFTRKFEHTPESDKKDAQAGTQTNGAQTASNTAGDTNGKTKTYEVEVCCSNLNYLKYGMLTRKNSKSAMQAGGNSSQADAKTEQVEQSMFLQGERTDEKEIPTDQNVVYRGSWYGHIANGTSWSGNASDKEGGNRAEFTVNFADKKITGKLTAENRQAQTFTIEGMIQGNGFEGTAKTAESGFDLDQKNTTRTPKAYITDAKVKGGFYGPKAEELGGWFAYHKSDNGSATVVFGAKRQQPVQ

SEQ ID NO: 311 - protein, 314 aa, Neisseria meningitidis
SSSENSKLTTVLDAVELTLNDKKIKNLDNFSNAAQLVVDGIMIPLLPATKAVFDENRKYGPEFTRKFEHTAKEITELLGSRALLNGNSRNTKATARRTRTYEVEVCCSNLNYLKYGMLTRKVTWENVRQTAGGAVNQHKNVGVYNRYAVEQSMFLQGERTDEKEIPTDQNVVYRGSWYGHIANGTSWSGNASDKEGGNRAEFTVNFADKKITGKLTAENRQAQTFTIEGMIQGNGFEGTAKTAESGFDLDQKNTTRTPKAYITDAKVKGGFYGPKAEELGGWFAYTAQAALGGTRTAGSSATVVFGAKRQQPVQ

SEQ ID NO: 312 - protein, 255 aa, Neisseria meningitidis
SSSENSKLTTVLDAVELTLNDKKIKNLDNFSNAAQLVVDGIMIDLAGTEFTRKFEHTLNRWVKERIEQNQPLTYEVEVCCSNLNYLKYGMLTRKGKQVEQSMFLQGERTDEKEIPTDQNVVYRGSWYGHIANGTSWSGNASDKEGGNRAEFTVNFADKKITGKLTAENRQAQTFTIEGMIQGNGFEGTAKTAESGFDLDQKNTTRTPKAYITDAKVKGGFYGPKAEELGGWFAYHKSDNGSATVVFGAKRQQPVQ

SEQ ID NO: 313 - protein, 258 aa, Neisseria meningitidis
SSSENSKLTTVLDAVELTLNDKKIKNLDNFSNAAQLVVDGIMIPLLPYGTDEAEKFRDKSGVEFTRKFEHTTNGKTYEVEVCCSNLNYLKYGMLTRKGKQVEQSMFLQGERTDEKEIPTDQNVVYRGSWYGHIANGTSWSGNASDKEGGNRAEFTVNFADKKITGKLTAENRQAQTFTIEGMIQGNGFEGTAKTAESGFDLDQKNTTRTPKAYITDAKVKGGFYGPKAEELGGWFAYHKSDNGSATVVFGAKRQQPVQ

SEQ ID NO: 314 - DNA, 1076 bp, Haemophilus influenzae
ggatccgcgaccaccagcaccaccgcgaacgcgaaaaccgatgcgaccaccaacgcggaaaactttaccaccaaagatattagcagctttggcgaagcggattatctgctgattgataactatccggtgccgctgctgccggaaaccgaaaacagcggcgattttgcgaccagcaaacattatgaagtgcgcgataaaacctataaagtggaagcgtgctgcaaaaacctgagctatgtgaaatttggcatgtattatgaaaccaaacgcccggcggcgaaaccgaaagcgcagaaaaaaaaacgcaaaaaaaaaaaaaccggcgtgaaaagcgtgaaaaaaggcaaaaaaaaaattaaaaaaaaaaaaggcaccaaaaaagcggcggtgaaaaaaaaaggcagcaaaaaaaaagcggtgaaaggcaaaaaaaaagcgaaaaaaccgaaaaaaaaaagcccgaccaaaaaaggcggcagcggcagcaaaggcattctgccggcgccgaaagcgccgaaaggccgcaacattaaatatcatcagtttctgctgggcctgcgcaccgcgagcagcaaaattccgaccaccggcaacgtgaaatatcgcggcagctggtttggctatattagcgatggcgaaaccagctatagcaccaccggcgataaacgccaggataaaaacgcggtggcggaatttgatgtgaactttgcggaaaaaaccctgaaaggcagcctgaaacgcgcggatagccagaacccggtgtttagcattgaagcgaactttaaaaacggcggcaacgcgtttaccggcaccgcgaccgcgaaagatctggtgattgatggcaaaaacagccagaccaaaaacaccccgattaacattaccaccaaagtgaacggcgcgttttatggcccgaacgcgagcgaactgggcggctattttacctataacggcaaaaacccgaccgataaaaacagcccgaccgcgagcagcccgagcaacagcgaaaaagcgcgcgcggcggtggtgtttggcgcgaaaaaacaggtggaaaccaacaacaaataatctagaagctt

SEQ ID NO: 315 - protein, 352 aa, Haemophilus influenzae
ATTSTTANAKTDATTNAENFTTKDISSFGEADYLLIDNYPVPLLPETENSGDFATSKHYEVRDKTYKVEACCKNLSYVKFGMYYETKRPAAKPKAQKKKRKKKKTGVKSVKKGKKKIKKKKGTKKAAVKKKGSKKKAVKGKKKAKKPKKKSPTKKGGSGSKGILPAPKAPKGRNIKYHQFLLGLRTASSKIPTTGNVKYRGSWFGYISDGETSYSTTGDKRQDKNAVAEFDVNFAEKTLKGSLKRADSQNPVFSIEANFKNGGNAFTGTATAKDLVIDGKNSQTKNTPINITTKVNGAFYGPNASELGGYFTYNGKNPTDKNSPTASSPSNSEKARAAVVFGAKKQVETNNK

SEQ ID NO: 316 - protein, 273 aa, Actinobacillus pleuropneumoniae
GVSKEEYKDVETAKKEKEQLGELGELMEPALGYVVKVPVSSFENKKVDISDIEVITNGNLDDVPYKANSSKYNYPDIKTKDSSLQYVRSGYVIDGEHSGSNEKGYVYYKGNSPAKELPVNQLLTYTGSWDFTSNANLNNEEGRPNYLNDDYYTKFIGKRVGLVSGDAKPAKHKYTSQFEVDFATKKMTGKLSDKEKTIYTVNADIRGNRFTGAATASDKNKGKGESYNFFSADSQSLEGGFYGPKAEEMAGKFVANDKSLFAVFSAKHNGSNV

SEQ ID NO: 317 - protein, 246 aa, Actinobacillus pleuropneumoniae
GVSKEEYKDVETAKKEKEQLGELGELMEPALGYVVKVPVSAGKKVDISDIEVITNGNLDDVPYKANSSKYNYPDIKTKDSSLQYVRSGYVISPDGGYVYYKGNSPAKELPVNQLLTYTGSWDFTSNANLNAARPAGAGKRVGLVSGDAKERKYTSQFEVDFATKKMTGKLSDKEKTIYTVNADIRGNRFTGAATASDKNDPILSADSQSLEGGFYGPKAEEMAGKFVANDKSLFAVFSAKHNGSNV

The invention claimed is:

1. An immunogenic composition comprising a Transferrin binding protein B (TbpB) from a Gram-negative pathogenic bacterial species, the TbpB comprising a C-lobe domain or an N-lobe domain, wherein the C-lobe domain or the N-lobe domain comprise a plurality of β-strands interspersed with a plurality of loop domains, wherein at least one loop domain of the plurality of loop domains has been modified, and wherein the β-strands flanking the at least one modified loop domain are retained in unmodified form, and an adjuvant wherein the TbpB polypeptide is modified in such a manner that the value of the dissociation constant $K_d$ of the binding interaction between the native host iron binding protein and the modified TbpB is at least 10× higher than the value of the dissociation constant $K_d$ of the binding interaction between the native host iron binding protein and the native TbpB.

2. An immunogenic composition according to claim 1 wherein the at least one loop domain has been modified in that one amino acid in the at least one loop domain has been removed or replaced.

3. An immunogenic composition according to claim 1 wherein the loop domain has been modified in that it has been removed in its entirety.

4. The immunogenic composition according to claim 3 further comprising the replacement of the loop domain with a portion of an Integral Outer Membrane (TOM) polypeptide.

5. The immunogenic composition according to claim 4 wherein the TOM polypeptide is a TbpA polypeptide or a Lactoferrin binding protein A (LbpA) polypeptide.

6. An immunogenic composition according to claim 1 wherein the at least one loop domain is selected from any one of Loops L1 to Loops L32.

7. An immunogenic composition according to claim 6 wherein the at least one loop domain is selected from any one of Loops consisting of L1, L5, L8, L12, L18, L21, L23 and L27.

8. An immunogenic composition according to claim 1 wherein the TbpB polypeptide is obtainable from a bacterial species belonging to the bacterial family of the Pasteurellaceae, Moxarellaceae or Neisseriaceae.

9. An immunogenic composition according to claim 1 wherein the TbpB polypeptide is obtainable from a bacterial species belonging to the bacterial genus of *Actinobacillus, Neisseria, Haemophilus, Mannheimia, Histophilus, Pasteurella* or *Moraxella*.

10. An immunogenic composition according to claim 1 wherein the C-lobe domain is a C-lobe domain selected from the group set forth in SEQ.ID NO: 6; SEQ.ID NO: 22; SEQ.ID NO: 34; SEQ.ID NO: 119; SEQ.ID NO: 125; SEQ.ID NO: 179 to SEQ.ID NO: 195; SEQ.ID NO: 213 to SEQ.ID NO: 218; SEQ.ID NO: 230; SEQ.ID NO: 232; SEQ.ID NO: 234 to SEQ.ID NO: 278; and SEQ.ID NO: 288 to SEQ.ID NO: 292.

11. An immunogenic composition according to claim 1 wherein the N-lobe domain is an N-lobe domain selected from the group set forth in SEQ.ID NO: 8; SEQ.ID NO: 10; SEQ.ID NO: 24; SEQ.ID NO: 26; SEQ.ID NO: 36; SEQ.ID NO: 38; SEQ.ID NO: 121; SEQ.ID NO: 127; SEQ.ID NO: 229; SEQ.ID NO: 231; and SEQ.ID NO: 233.

12. An immunogenic composition according to claim 2 wherein the immunogenic composition comprises any of the polypeptides set forth in SEQ.ID NO: 170; SEQ.ID NO: 172; SEQ.ID NO: 174; SEQ.ID NO; 176; SEQ.ID NO: 4; SEQ.ID NO: 14; SEQ.ID NO: 16; SEQ.ID NO: 18; SEQ.ID NO: 20; SEQ.ID NO: 30 and SEQ.ID NO: 32.

13. An immunogenic composition according to claim 5 wherein the TbpA and LbpA polypeptides are selected from SEQ.ID NO: 152 and SEQ.ID NO: 162.

14. An immunogenic composition according to claim 5 wherein the immunogenic composition comprises a polypeptide having the sequence set forth in SEQ.ID NO: 154; SEQ.ID NO: 156; SEQ.ID NO: 158; SEQ.ID NO: 160; SEQ.ID NO: 164, SEQ.ID NO: 166.

15. A vaccine composition comprising an immunogenic composition according to claim 1.

16. A method for preparing an immunogenic composition comprising:

(a) providing a chimeric nucleic acid sequence comprising as operably linked components:
   (i) a nucleic acid sequence encoding a modified polypeptide comprising the TbpB of claim 1; and
   (ii) a nucleic acid sequence capable of controlling expression in a recombinant host cell;
(b) introducing the chimeric nucleic acid sequence into a host cell and growing the host cell to produce the polypeptide comprising the C-lobe domain or N-lobe domain;
(c) recovering the polypeptide comprising C-lobe domain or N-lobe domain from the host cell; and
(d) preparing an immunogenic composition.

17. The method according to claim 16 wherein the modified polypeptide is a polypeptide in which at least one loop domain has been removed in its entirety.

18. A method for eliciting an immune response in a vertebrate subject, said method comprising administering the immunogenic composition of claim 1 to the subject.

19. An immunogenic composition according to claim 1 wherein at least two loop domains have been modified in that one amino acid in each of the at least two loop domains have been removed or replaced.

20. An immunogenic composition according to claim 1 wherein the at least two loop domains are independently selected from any two of Loops L1 to Loops L32.

21. An immunogenic composition according to claim 20 wherein the at least two loop domains are independently selected from any two Loops consisting of L1, L5, L8, L12, L18, L21, L23 and L27.

22. An immunogenic composition according to claim 2 wherein the immunogenic composition comprises the polypeptide set forth in SEQ.ID NO: 170.

23. An immunogenic composition according to claim 2 wherein the immunogenic composition comprises the polypeptide set forth in SEQ.ID NO: 172.

24. An immunogenic composition according to claim 2 wherein the immunogenic composition comprises the polypeptide set forth in SEQ.ID NO: 174.

25. An immunogenic composition according to claim 2 wherein the immunogenic composition comprises the polypeptide set forth in SEQ.ID NO: 176.

26. An immunogenic composition according to claim 2 wherein the immunogenic composition comprises the polypeptide set forth in SEQ.ID NO: 4.

27. An immunogenic composition according to claim 2 wherein the immunogenic composition comprises the polypeptide set forth in SEQ.ID NO: 14.

28. An immunogenic composition according to claim 2 wherein the immunogenic composition comprises the polypeptide set forth in SEQ.ID NO: 16.

29. An immunogenic composition according to claim 2 wherein the immunogenic composition comprises the polypeptide set forth in SEQ.ID NO: 18.

30. An immunogenic composition according to claim 2 wherein the immunogenic composition comprises the polypeptide set forth in SEQ.ID NO: 20.

31. An immunogenic composition according to claim 2 wherein the immunogenic composition comprises the polypeptide set forth in SEQ.ID NO: 30.

32. An immunogenic composition according to claim 2 wherein the immunogenic composition comprises the polypeptide set forth in SEQ.ID NO: 32.

33. A vaccine composition comprising an immunogenic composition according to claim 19.

* * * * *

UNITED STATES PATENT AND TRADEMARK OFFICE
CERTIFICATE OF CORRECTION

PATENT NO. : 10,149,900 B2
APPLICATION NO. : 15/100867
DATED : December 11, 2018
INVENTOR(S) : Anthony B. Schryvers, Trevor F. Moraes and Scott Gray-Owen It is certified that error appears in the above-identified patent and that said Letters Patent is hereby corrected as shown below:

In the Claims

Claim 4 Column 103, Line 39, "(TOM)" should read --(IOM)--;

Claim 5 Column 103, Line 42, "TOM" should read --IOM--;

Claim 20 Column 104, Line 61, "claim 1" should read --claim 19--.

Signed and Sealed this
Twenty-sixth Day of February, 2019

Andrei Iancu
*Director of the United States Patent and Trademark Office*